US012735488B2

(12) United States Patent
Su et al.

(10) Patent No.: US 12,735,488 B2
(45) Date of Patent: Sep. 15, 2026

(54) ANTIBODIES BINDING TO VISTA AT ACIDIC PH

(71) Applicant: Bristol-Myers Squibb Company, Princeton, NJ (US)

(72) Inventors: Lin Hui Su, Somerville, MA (US); Sabrina Mueller, Mountain View, CA (US)

(73) Assignee: Bristol-Myers Squibb Company, Princeton, NJ (US)

( * ) Notice: Subject to any disclaimer, the term of this patent is extended or adjusted under 35 U.S.C. 154(b) by 1218 days.

(21) Appl. No.: 17/761,458

(22) PCT Filed: Sep. 18, 2020

(86) PCT No.: PCT/US2020/051421

§ 371 (c)(1),
(2) Date: Mar. 17, 2022

(87) PCT Pub. No.: WO2021/055698

PCT Pub. Date: Mar. 25, 2021

(65) Prior Publication Data

US 2023/0192860 A1 Jun. 22, 2023

Related U.S. Application Data

(60) Provisional application No. 62/916,690, filed on Oct. 17, 2019, provisional application No. 62/902,741, filed on Sep. 19, 2019.

(51) Int. Cl.
*C07K 16/28* (2006.01)
*A61P 35/00* (2006.01)
*A61K 39/00* (2006.01)

(52) U.S. Cl.
CPC .......... *C07K 16/2827* (2013.01); *A61P 35/00* (2018.01); *A61K 2039/505* (2013.01); *C07K 2317/33* (2013.01); *C07K 2317/34* (2013.01); *C07K 2317/565* (2013.01); *C07K 2317/76* (2013.01); *C07K 2317/92* (2013.01); *C07K 2317/94* (2013.01)

(58) Field of Classification Search
CPC ............ C07K 16/2827; C07K 2317/33; C07K 2317/34; C07K 2317/565; C07K 2317/76; C07K 2317/92; C07K 2317/94; C07K 2317/75; C07K 16/2818; C07K 16/2896; C07K 16/2803; A61P 35/00; A61P 31/12; A61P 37/06; A61K 2039/505; A61K 2039/507
See application file for complete search history.

(56) References Cited

U.S. PATENT DOCUMENTS

| | | | |
|---|---|---|---|
| 4,997,913 A | 3/1991 | Hellstrom et al. | |
| 5,827,817 A | 10/1998 | Larsen et al. | |
| 7,833,530 B2 | 11/2010 | Alvarez et al. | |
| 8,114,968 B2 | 2/2012 | Devy et al. | |
| 8,889,628 B2 | 11/2014 | Shaw | |
| 10,259,866 B2 | 4/2019 | Nitsch et al. | |
| 11,014,987 B2 | 5/2021 | Snyder et al. | |
| 2005/0260711 A1 | 11/2005 | Datta et al. | |
| 2010/0260765 A1 | 10/2010 | Barry et al. | |
| 2010/0330078 A1 | 12/2010 | Bender et al. | |
| 2011/0027278 A1 | 2/2011 | Noelle et al. | |
| 2011/0081666 A1 | 4/2011 | Alvarez et al. | |
| 2011/0172397 A1 | 7/2011 | Lin et al. | |
| 2012/0100140 A1 | 4/2012 | Reyes et al. | |
| 2012/0108455 A1 | 5/2012 | Kodandapani et al. | |
| 2012/0148571 A1 | 6/2012 | Lasters et al. | |
| 2014/0056892 A1* | 2/2014 | Noelle | A61K 38/21 424/134.1 |
| 2014/0105912 A1 | 4/2014 | Noelle | |
| 2014/0341920 A1 | 11/2014 | Noelle et al. | |
| 2014/0378660 A1 | 12/2014 | Short et al. | |
| 2015/0265703 A1 | 9/2015 | Herting et al. | |
| 2015/0337053 A1 | 11/2015 | McCarthy et al. | |
| 2016/0096891 A1 | 4/2016 | Chen et al. | |
| 2016/0159927 A1 | 6/2016 | Molloy et al. | |
| 2016/0176963 A1 | 6/2016 | Maurer et al. | |
| 2016/0347814 A1 | 12/2016 | Levine et al. | |
| 2016/0347849 A1 | 12/2016 | Cai et al. | |
| 2017/0051061 A1 | 2/2017 | Snyder et al. | |
| 2017/0119877 A1 | 5/2017 | Green et al. | |
| 2017/0198052 A1 | 7/2017 | Lin et al. | |

(Continued)

FOREIGN PATENT DOCUMENTS

| | | | |
|---|---|---|---|
| CN | 104968364 A | 10/2015 |
| CN | 105246507 A | 1/2016 |

(Continued)

OTHER PUBLICATIONS

African Journal of Biotechnology, 10(79):18294-18302, 2011 (Year: 2011).*
Annu. Rev. Biophys. Biophys. Chem., 16: 139-159, 1987 (Year: 1987).*
J. Immunol. Methods, 251(1-2): 137-149, 2001 (Year: 2001).*
Almagaro et al., "Humanization of Antibodies," Frontiers in Bioscience, 2008, 13:1619-1633.
Casset et al., "A peptide mimetic of an anti-CD4 monoclonal antibody by rational design," Biochem. and Biophys. Res. Comm., 2003, 307:198-205.
Chen et al., "Selection and Analysis of an Optimized Anti-VEGF Antibody: Crystal Structure of an Affinity-matured Fab in Complex with Antigen," J. Mol. Biol., 1999, 293:865-881.

(Continued)

*Primary Examiner* — Nelson B Moseley, II
*Assistant Examiner* — Josephine K Darpolor
(74) *Attorney, Agent, or Firm* — McNeill PLLC

(57) ABSTRACT

The present application relates to antibodies specifically binding to the V-domain immunoglobulin-containing suppressor of T-cell activation (VISTA) at acidic pH and their use in cancer treatment. In some embodiments, the antibodies bind specifically to human VISTA at acidic pH, but do not significantly bind to human VISTA at neutral or physiological pH.

23 Claims, 86 Drawing Sheets

Specification includes a Sequence Listing.

(56) References Cited

U.S. PATENT DOCUMENTS

| | | | |
|---|---|---|---|
| 2019/0330364 A1 | 10/2019 | Johnston et al. |
| 2020/0055936 A1 | 2/2020 | Johnston et al. |
| 2021/0017283 A1 | 1/2021 | Johnston et al. |
| 2022/0073617 A1 | 3/2022 | Johnston et al. |
| 2023/0192860 A1 | 6/2023 | Su et al. |
| 2023/0310634 A1 | 10/2023 | Rothstein et al. |

FOREIGN PATENT DOCUMENTS

| | | | | |
|---|---|---|---|---|
| CN | 106414489 A | 2/2017 | | |
| CN | 110563843 A | 12/2019 | | |
| CN | 110740749 A | 1/2020 | | |
| CN | 111971304 A | 11/2020 | | |
| CN | 112638948 A | 4/2021 | | |
| CN | 114729043 A | 7/2022 | | |
| RU | 2550262 C1 | 5/2015 | | |
| TW | 201619195 A | 6/2016 | | |
| WO | 9201718 A2 | 2/1992 | | |
| WO | 9410309 A1 | 5/1994 | | |
| WO | 9411498 A1 | 5/1994 | | |
| WO | 9506118 A1 | 3/1995 | | |
| WO | 9530001 A2 | 11/1995 | | |
| WO | 9706176 A2 | 2/1997 | | |
| WO | 1997009068 A2 | 3/1997 | | |
| WO | 9808949 A1 | 3/1998 | | |
| WO | 9931117 A1 | 6/1999 | | |
| WO | 0000610 A2 | 1/2000 | | |
| WO | 2000012708 A2 | 3/2000 | | |
| WO | 2000078961 A1 | 12/2000 | | |
| WO | 0104297 A2 | 1/2001 | | |
| WO | 0173028 A2 | 10/2001 | | |
| WO | 2003105757 A2 | 12/2003 | | |
| WO | 2004022594 A2 | 3/2004 | | |
| WO | 2003013603 | 6/2004 | | |
| WO | 2005027831 A2 | 3/2005 | | |
| WO | 2005110475 A2 | 11/2005 | | |
| WO | 2006012232 A1 | 2/2006 | | |
| WO | 2006116181 A2 | 11/2006 | | |
| WO | 2007033959 A2 | 3/2007 | | |
| WO | 2007067984 A2 | 6/2007 | | |
| WO | 2007100211 A1 | 9/2007 | | |
| WO | 2009140623 A2 | 11/2009 | | |
| WO | 2010104821 A1 | 9/2010 | | |
| WO | 2011120013 A2 | 9/2011 | | |
| WO | 2005110456 | 2/2012 | | |
| WO | 2012033953 A1 | 3/2012 | | |
| WO | 2012174001 A1 | 12/2012 | | |
| WO | 2013082200 A1 | 6/2013 | | |
| WO | 2013134743 A1 | 9/2013 | | |
| WO | 2013192504 A1 | 12/2013 | | |
| WO | 2014039983 A1 | 3/2014 | | |
| WO | 2014089113 A1 | 6/2014 | | |
| WO | 2014190356 A2 | 11/2014 | | |
| WO | 2014197849 A2 | 12/2014 | | |
| WO | 2015069770 A1 | 5/2015 | | |
| WO | 2015097536 A2 | 7/2015 | | |
| WO | 2015109340 A2 | 7/2015 | | |
| WO | 2015187359 A1 | 12/2015 | | |
| WO | 2015191881 A2 | 12/2015 | | |
| WO | 2016007653 A2 | 1/2016 | | |
| WO | 2016090347 A1 | 6/2016 | | |
| WO | 2016094837 A2 | 6/2016 | | |
| WO | 2016207717 A1 | 12/2016 | | |
| WO | 2017078839 A1 | 5/2017 | | |
| WO | 2017120534 A1 | 7/2017 | | |
| WO | 2017137830 A1 | 8/2017 | | |
| WO | 2017175058 A1 | 10/2017 | | |
| WO | 2017181109 A1 | 10/2017 | | |
| WO | 2017181139 A2 | 10/2017 | | |
| WO | 2018027042 A1 | 2/2018 | | |
| WO | 2018047143 A1 | 3/2018 | | |
| WO | 2018132476 A1 | 7/2018 | | |
| WO | WO-2018169993 A1 * | 9/2018 | ............. | A61P 35/00 |
| WO | 2018195772 A1 | 11/2018 | | |
| WO | 2018237287 A1 | 12/2018 | | |
| WO | 2019078699 A2 | 4/2019 | | |
| WO | 2019087092 A1 | 5/2019 | | |
| WO | 2019165233 A1 | 8/2019 | | |
| WO | 2019183040 A1 | 9/2019 | | |
| WO | 2019185163 A1 | 10/2019 | | |
| WO | 2019185879 A1 | 10/2019 | | |
| WO | 2020014327 A2 | 1/2020 | | |
| WO | 2021055698 A1 | 3/2021 | | |

OTHER PUBLICATIONS

De Pascalis et al., "Grafting of "Abbreviated" Complementarity-Determining Regions Containing Specificity-Determining Residues Essential for Ligand Contact to Engineer a Less Immunogenic Humanized Monoclonal Antibody," J Immunol., 2002, 169:3076-3084.

Lamminmaki et al., "Crystal Structure of a Recombinant Anti-estradiol Fab Fragment in Complex with 17β-Estradiol," J. Biol. Chem., 2001, 276(39): 36687-36694.

MacCallum et al., "Antibody-antigen Interactions: Contact Analysis and Binding Site Topography," J. Mol. Biol., 1996, 262:732-745.

Padlan et al., "Structure of an antibody-antigen complex: Crystal Structure of the HyHEL-10 Fab-lysozyme complex," Proc. Natl. Acad. Sci. USA, 1989, 86:5938-5942.

Rudikoff et al., "Single amino acid substitution altering antigen-binding specificity," Proc. Natl. Acad. Sci. USA, 1982, 79:1979-1983.

Vajdos et al., "Comprehensive Functional Maps of the Antigen-binding Site of an Anti-ErbB2 Antibody Obtained with Shotgun Scanning of Mutagenesis," J. Mol. Biol., 2002, 320:415-428.

Wu et al., "Humanization of a Murine Monoclonal Antibody by Simultaneous Optimization of Framework and CDR Residues," J. Mol. Biol., 1999, 294:151-162.

Ji et al., "Enhancing the Efficacy of Anti-tumor Immunotherapy by Targeting T cell Metabolism," J Nutr Oncol, 2019, 4(2): 67-73.

Xuan et al., "Research progress on immune checkpoint molecule immunoglobulin variable domain inhibitor of T Cell activation (VISTA)," Chin J Cell Mol Immunol, 2017, 33(2): 266-269.

Zhou et al, "Important progress in international immunology research in 2019," Immunological Journal, 2020, 36(1): 1-10.

Lobo et al., "Antibody Pharmacokinetics and Pharmacodynamics". J Pharm Sci., 2004; 93(11):2645-68.

English translation of Search Report received in Chinese Patent Application No. 201980020908.X, dated Mar. 11, 2025, 2 pages.

File History of U.S. Appl. No. 18/939,765, filed Nov. 7, 2024, Inventors: Robert J. Johnston et al., available on Patent Center.

Liu et al., "Clinical Diagnosis and Treatment of Infectious Diseases and Disease Control," Jilin Science and Technology Press, Mar. 31, 2018, 10 pages.

File History of U.S. Appl. No. 18/543,912, filed Dec. 18, 2023, Inventors: Robert J. Johnston et al., available on Patent Center.

GenBank AAA53000.1, immunoglobin heavy chain, partial, Jul. 26, 2016, 4 pages.

GenBank ABF83385.1, circulating B cell antibody heavy chain variable region, partial, Jul. 14, 2016, 4 pages.

Machine translation of RU2550262, May 10, 2015, Pigareva et al., 10 pages.

PIR: S23628, Ig kappa chain V region—human (fragment), Jan. 21, 2000, 2 pages.

Bostrom et al., "Improving Antibody Binding Affinity and Specificity for Therapeutic Development," Methods Mol. Biol., 2009, 525:353-376.

Brown et al., "Tolerance to Single, but Not Multiple, Amino Acid Replacements in Antibody Vh CDR2: A Means of Minimizing B Cell Wastage from Somatic Hypermutation?," J Immunol, 1996, 156:3285-3291.

Deng et al, "A New VISTA on combination therapy for negative checkpoint regulator blockade," J Immunotherapy Cancer, 2016, 4(1):1-7.

Extended European Search Report received in European Patent Application No. 18738529.9 dated Jul. 3, 2020, Applicant: Bristol-Myers Squibb Company, 7 pages.

(56) References Cited

OTHER PUBLICATIONS

File History of U.S. Appl. No. 16/476,814, filed Jul. 9, 2019, Inventors: Robert J. Johnston et al.
File History of U.S. Appl. No. 16/493,712, filed Sep. 12, 2019, Inventors: Robert J. Johnston et al.
File History of U.S. Appl. No. 16/982,277, filed Sep. 18, 2020, Inventors: Robert J. Johnston et al.
File History of U.S. Appl. No. 17/258,866, filed Jan. 8, 2021, Inventors: Robert J. Johnston et al.
File History of U.S. Appl. No. 17/695,081, filed Mar. 15, 2022, Inventors: Robert J. Johnston et al.
Gonzales et al., "Minimizing the Immunogenicity of Antibodies for Clinical Application," Tumour Biol, 2005, 26(1):31-43.
International Search Report and Written Opinion for PCT/US2019/041154, dated Jan. 24, 2020, Applicant: Five Prime Therapeutics, Inc.; 21 pages.
International Search Report and Written Opinion for PCT/US2020/051421, dated Mar. 11, 2021, Applicant: Bristol-Myers Squibb Company, 30 pages.
International Search Report for PCT/US2018/013171, dated May 14, 2018, Applicant: Bristol-Myers Squibb Company, 16 pages.
International Search Report for PCT/US2018/022230, dated May 31, 2018, Applicant: Five Prime Therapeutics, Inc., 21 pages.
International Search Report for PCT/US2019/022895, dated Jul. 16, 2019, Applicant: Five Prime Therapeutics, Inc.; 14 pages.
Johnston et al., "Acidic pH Selective Binding of Vista to PSGL-1 and Anti-Tumor Activity of Combined Vista and PD-1 Blockade," Cancer Research, 2019, 70(13): supplement.
Johnston et al., "Vista is an Acidic pH-Selective Ligand for PSGL-1," Nature, 2019, 574:565-588.
Krieg et al., "Functional Analysis of B and T Lymphocyte Attenuator engagement on CD4+ and CD8+ T Cells," J Immunology, 2005, 175(10):6420-6427.
Kunik et al, "Structural Consensus among Antibodies Defines the Antigen Binding Site," PLoS Comput Biol, 2012, 8(2):e1002388, 12 pages.
Le Mercier et al., "Vista Regulates the Development of Protective Antitumor Immunity," Cancer Res., 2014, 74(7):1933-1944.
Lenter et al., "Monospecific and Common Glycoprotein Ligands for E- and P-Selectin on Myeloid Cells," J. Cell Biol., 1994, 125(2):471-481.
Lines et al., "Vista is a Novel Broad-Spectrum Negative Checkpoint Regulator for Cancer Immunotherapy," Cancer Immunol Res., 2014, 2(6):510-517.
Machine Translation of CN110563843A.
Machine Translation of WO 2019/078699, 41 pages.
Mahoney et al., "Acidity Changes Immunology: A New Vista Pathway," Nature Immunology, 2020, 21:13-16.
Mangsbo et al., "The Human Agonistic CD40 Antibody ADC-1013 Eradicates Bladder Tumors and Generates T-cell-Dependent Tumor Immunity," Clin Cancer Res, 2015, 21(5):1115-26.
Matsumoto et al., "P-Selectin Glycoprotein Ligand-1 Negatively Regulates T-Cell Immune Responses," J Immunol, 2009, 183:7204-7211.
Morris, "Epitope Mapping of Protein Antigens by Competition ELISA", The Protein Protocols Handbook, Totowa, NJ, Humana Press, 1996, pp. 595-600.
Supplementary Extended European Search Report received in European Patent Application No. 18767615.0 dated Apr. 29, 2021, 12 pages.
Tinoco et al., "PSGL-1 Is an Immune Checkpoint Regulator that Promotes T Cell Exhaustion," Immunity, 2016, 44:1190-1203.
Wang et al., "Vista, a novel mouse Ig superfamily ligand that negatively regulates T cell responses," J. Exp. Med., 2011, 208(3):577-592.
Wark et al., "Latest Technologies for the Enhancement of Antibody Affinity," Adv Drug Delivery Rev, 2006, 58 (5-6):657-670.
Zhao et al., "Oncogenic Pathways that Affect Antitumor Immune Response and Immune Checkpoint Blockade Therapy," Pharmacology & Therapeutics, 2018, 181:76-84.
Zhu et al., "B7—H5 costimulates human T cells via CD28H," Nature Comm, 2013, 4:1-12.
Liu, "Pharmacokinetics of monoclonal antibodies and Fc-fusion proteins," Protein Cell, 2018, 9(1):15-32.
File History of U.S. Appl. No. 18/162,991, filed Feb. 1, 2023, Inventors: Robert J. Johnston et al.
Krishnamurthy et al., "Glycopeptide analogues of PSGL-1 inhibit P-selectin in vitro and in vivo," Nature Communications, 2015, 6:6387 (12 pages).
Muz et al., "Inhibition of P-Selectin and PSGL-1 Using Humanized Monoclonal Antibodies Increases the Sensitivity of Multiple Myeloma Cells to Bortezomib," BioMed Res International, 2015, Article 417586, pp. 1-8.

* cited by examiner

Hu/Cy/Ms conserved histidines (bold, underlined)
Hu/Cy-conserved histidines (bold)

Human NP_071436.1 Sig- FKVATPYSLYVCPEGQNVTLTCRLLGPVDKGHDVTFYKTWYR
Cyno XP_005565644.1 Sig- FKVATLYSLYVCPEGQNVTLTCRVFGPVDKGHDVTFYKTWYR
Mouse NP_083008.1 Sig- FKVTTPYSLYVCPEGQNATLTCRILGPVSKGHDVTIYKTWYL Human NP_071436.1 SSRGEVQTCSERRPIRNLTFQDLHLHHGGHQAANTSHDLAQRHGLES
Cyno XP_005565644.1 SSRGEVQTCSERRPIRNLTFQDLHLHHGGHQAANTSHDLAQRHGLES
Mouse NP_083008.1 SSRGEVQMCKEHRPIRNFTLQHLQ-HHGSHLKANASHDQPQKHGLEL Human NP_071436.1 ASDHHGNFSITMRNLTLLDSGLYCCLVVEIRHHHSEHRVHGAMELQV
Cyno XP_005565644.1 ASDHHGNFSITMRNLTLLDSGLYCCLVVEIRHHHSEHRVHGAMELQV
Mouse NP_083008.1 ASDHHGNFSITLRNVTPRDSGLYCCLVIELKNHHPEQRFYGSMELQV Human NP_071436.1 QTGKDAPSNCVVYPSSSQDSENITAA -TMD
Cyno XP_005565644.1 QTGKDAPSSCVAYPSSSQESENITAA -TMD
Mouse NP_083008.1 QAGKGSGSTCMA--SNEQDSDSITAA -TMD

FIG. 1B $pK_a \sim 6.5$

1. X = H, D, or E
2. Bracketed sequences were removed from synthesis to avoid introducing liabilities
3. A total of 647 unique sequences of P1-061029 HCDR3 with 1-2 mutations were synthesized

| Antibody | P1 ID | pH 7.4 | | | pH 6.7 | | | pH 6.0 | | | HCDR1 | HCDR2 | HCDR3 |
|---|---|---|---|---|---|---|---|---|---|---|---|---|---|
| | | kd (1/s) | KD (M) | hVISTA %Rmax | kd (1/s) | KD (M) | hVISTA %Rmax | kd (1/s) | KD (M) | hVISTA %Rmax | | | |
| P1-068761_E100fF | P1-070874 | 1.3E-03 | 2.0E-08 | 73.3 | 2.2E-04 | 1.3E-09 | 117.0 | 1.3E-04 | 1.9E-10 | 130.1 | ....E.E... | ......EE......... | .....H........ |
| P1-068761_E55A_E100fF | P1-070898 | 1.7E-03 | 1.4E-08 | 82.3 | 2.8E-04 | 1.5E-09 | 119.8 | 1.8E-04 | 2.6E-10 | 133.7 | ....E.E... | .......E......... | .....H........ |
| P1-068761_H100G_E100fF | P1-070880 | 2.3E-03 | 4.1E-08 | 61.8 | 4.0E-04 | 2.3E-09 | 116.7 | 2.1E-04 | 2.3E-10 | 126.7 | ....E.E... | ......EE......... | .............. |
| P1-068761_E30D_E100fF | P1-070896 | 3.5E-03 | 4.8E-08 | 65.2 | 5.7E-04 | 3.7E-09 | 112.6 | 3.3E-04 | 4.3E-10 | 130.4 | ......E... | ......EE......... | .....H........ |
| P1-068761_E56N_E100fF | P1-070902 | 3.0E-03 | 6.5E-08 | 47.4 | 6.1E-04 | 6.5E-09 | 85.9 | 3.8E-04 | 1.4E-09 | 116.5 | ....E.E... | ......E.......... | .....H........ |
| P1-068761_E32Y | P1-070866 | 2.5E-03 | 1.8E-08 | 102.5 | 6.4E-04 | 1.6E-09 | 120.9 | 4.1E-04 | 2.1E-10 | 123.1 | ....E..... | ......EE......... | .....H.....E.. |
| P1-068761_E32Y_E55A | P1-070882 | 2.7E-03 | 2.3E-08 | 89.3 | 6.0E-04 | 2.0E-09 | 116.3 | 5.7E-04 | 3.1E-10 | 117.6 | ....E..... | .......E......... | .....H.....E.. |
| P1-068761_E32Y_E56N | P1-070884 | 3.2E-03 | 4.2E-08 | 73.7 | 8.3E-04 | 5.1E-09 | 104.4 | 7.0E-04 | 1.2E-09 | 115.8 | ....E..... | ......E.......... | .....H.....E.. |
| P1-068761_E30D_E32Y | P1-070876 | 3.5E-03 | 2.1E-08 | 110.8 | 9.9E-04 | 2.0E-09 | 124.0 | 7.1E-04 | 2.4E-10 | 124.9 | .......... | ......EE......... | .....H.....E.. |
| P1-068761_E32Y_H100G | P1-070886 | 5.5E-03 | 7.2E-08 | 68.0 | 1.3E-03 | 5.0E-09 | 113.4 | 9.2E-04 | 4.8E-10 | 120.4 | ....E..... | ......EE......... | ...........E.. |
| P1-068761_E32Y_E100fF | P1-070888 | 1.9E-03 | 3.7E-09 | 132.1 | 9.5E-04 | 1.1E-09 | 125.0 | 1.1E-03 | 2.5E-10 | 120.8 | ....E..... | ......EE......... | .....H........ |
| P1-068761 | P1-068761 | **NB** | **NB** | 0.7 | 6.6E-03 | 7.1E-08 | 49.7 | 1.4E-03 | 2.6E-09 | 122.5 | ....E.E... | ......EE......... | .....H.....E.. |
| P1-068761_E55A | P1-070868 | **NB** | **NB** | 2.8 | 6.4E-03 | 1.2E-07 | 42.2 | 1.7E-03 | 3.4E-09 | 113.1 | ....E.E... | .......E......... | .....H.....E.. |
| P1-068761_H100G | P1-070872 | **NB** | **NB** | 2.9 | 1.4E-02 | 2.3E-07 | 36.1 | 5.2E-03 | 4.4E-09 | 121.0 | ....E.E... | ......EE......... | ...........E.. |
| P1-068761_E56N | P1-070870 | **NB** | **NB** | 1.7 | >1E-02 | ~8.2E-06 | 17.6 | 5.5E-03 | 1.9E-08 | 86.3 | ....E.E... | ......E.......... | .....H.....E.. |
| P1-068761_E55A_E56N | P1-070878 | **NB** | **NB** | 0.9 | 2.9E-02 | 2.1E-07 | 16.4 | 5.6E-03 | 2.1E-08 | 79.3 | ....E.E... | ................. | .....H.....E.. |
| P1-068761_E30D | P1-070864 | **NB** | **NB** | 0.4 | 1.8E-02 | 3.7E-07 | 25.6 | 6.2E-03 | 8.3E-09 | 109.9 | ......E... | ......EE......... | .....H.....E.. |
| P1-068761_E30D_E55A | P1-070890 | **NB** | **NB** | 1.8 | >1E-02 | ~1.1E-07 | 22.1 | 7.4E-03 | 1.2E-08 | 99.1 | ......E... | .......E......... | .....H.....E.. |
| P1-061029 | P1-061029 | 7.5E-03 | 3.2E-08 | 93.4 | 4.4E-03 | 1.1E-08 | 96.9 | 8.2E-03 | 4.5E-09 | 98.5 | GFTLDDYAMH | GINWNSANIGYADSVKG | VPGYSGGWIDAFDV |
| P1-068761_E56N_H100G | P1-070900 | **NB** | **NB** | 4.4 | **NB** | **NB** | 19.4 | 8.1E-03 | 1.0E-08 | 110.9 | ....E.E... | ......E.......... | ...........E.. |
| P1-068761_E30D_H100G | P1-070894 | **NB** | **NB** | 3.1 | >1E-02 | ~8.1E-08 | 14.6 | 2.1E-02 | 1.5E-08 | 91.9 | ......E... | ......EE......... | ...........E.. |
| P1-068761_E30D_E56N | P1-070892 | **NB** | **NB** | 0.4 | >1E-02 | ~3.2E-08 | 8.3 | 3.4E-02 | 5.0E-08 | 56.3 | ......E... | ......E.......... | .....H.....E.. |

FIG. 10A

| Antibody | P1 ID | pH 7.4 | | | pH 6.7 | | | pH 6.0 | | | HCDR1 | HCDR2 | HCDR3 |
|---|---|---|---|---|---|---|---|---|---|---|---|---|---|
| | | kd (1/s) | KD (M) | hVISTA %Rmax | kd (1/s) | KD (M) | hVISTA %Rmax | kd (1/s) | KD (M) | hVISTA %Rmax | | | |
| P1-068767_D52N_D102V | P1-070930 | 6.7E-03 | 8.7E-08 | 60.0 | 1.8E-03 | 7.5E-09 | 101.0 | 1.2E-03 | 8.8E-10 | 114.6 | ....E..... | ......E.......... | ...........E.. |
| P1-068767_D52N | P1-070906 | NB | NB | 3.9 | 6.7E-03 | 2.1E-07 | 38.9 | 1.5E-03 | 3.2E-09 | 116.6 | ....E..... | ......E.......... | ...........E.D |
| P1-068767_D52N_E55A | P1-070916 | NB | NB | 2.3 | 5.5E-03 | 1.2E-07 | 33.7 | 1.5E-03 | 4.0E-09 | 112.0 | ....E..... | ................. | ...........E.D |
| P1-068767_E55A_D102V | P1-070932 | 1.0E-02 | 2.8E-07 | 35.4 | 3.1E-03 | 1.5E-08 | 85.7 | 2.0E-03 | 1.9E-09 | 111.3 | ....E..... | ..D.............. | ...........E.. |
| P1-068767_D102V | P1-070912 | 9.2E-03 | 1.7E-07 | 44.7 | 2.8E-03 | 1.4E-08 | 98.5 | 2.0E-03 | 1.3E-09 | 111.9 | ....E..... | ..D...E.......... | ...........E.. |
| P1-068767_E55A | P1-070908 | NB | NB | 2.8 | 8.5E-03 | 3.8E-07 | 26.8 | 2.3E-03 | 5.7E-09 | 108.0 | ....E..... | ..D.............. | ...........E.D |
| P1-068767_E30D_D52N | P1-070914 | NB | NB | 4.5 | 1.1E-02 | 1.2E-07 | 35.8 | 2.3E-03 | 5.8E-09 | 105.7 | .......... | ......E.......... | ...........E.D |
| P1-068767 | P1-068767 | NB | NB | 1.9 | 7.2E-03 | 1.8E-07 | 31.1 | 2.4E-03 | 5.2E-09 | 111.7 | ....E..... | ..D...E.......... | ...........E.D |
| P1-068767_E30D_D102V | P1-070926 | 1.1E-02 | 2.2E-07 | 40.8 | 3.5E-03 | 1.7E-08 | 95.7 | 3.0E-03 | 2.1E-09 | 114.8 | .......... | ..D...E.......... | ...........E.. |
| P1-068767_E30D | P1-070904 | NB | NB | 5.8 | NB | NB | 21.0 | 3.2E-03 | 9.6E-09 | 99.8 | .......... | ..D...E.......... | ...........E.D |
| P1-068767_E30D_E55A | P1-070922 | NB | NB | 3.5 | NB | NB | 22.6 | 3.5E-03 | 8.3E-09 | 108.8 | .......... | ..D.............. | ...........E.D |
| P1-061029 | P1-061029 | 7.5E-03 | 3.2E-08 | 93.4 | 4.4E-03 | 1.1E-08 | 96.9 | 8.2E-03 | 4.5E-09 | 98.5 | GFTLDDYAMH | GINWNSANIGYADSVKG | VPGYSGGWIDAFDV |
| P1-068767_E100fF_D102V | P1-070920 | 8.3E-03 | 4.1E-08 | 86.8 | 4.7E-03 | 1.1E-08 | 103.4 | 8.2E-03 | 2.7E-09 | 103.4 | ....E..... | ..D...E.......... | .............. |
| P1-068767_E55A_E100fF | P1-070918 | NB | NB | 1.8 | NB | NB | 8.6 | 1.3E-02 | 6.2E-08 | 42.5 | ....E..... | ..D.............. | .............D |
| P1-068767_D52N_E100fF | P1-070928 | NB | NB | 9.4 | >1E-02 | ~3.9E-08 | 22.7 | 6.6E-02 | 2.0E-08 | 64.0 | ....E..... | ......E.......... | .............D |
| P1-068767_E100fF | P1-070910 | NB | NB | 1.8 | 2.6E-02 | 5.2E-06 | 9.6 | >1E-02 | ~4.2E-08 | 49.4 | ....E..... | ..D...E.......... | .............D |
| P1-068767_E30D_E100fF | P1-070924 | NB | NB | 1.0 | 2.7E-02 | 1.0E-05 | 7.0 | >1E-02 | ~8.2E-08 | 32.9 | .......... | ..D...E.......... | .............D |

FIG. 10B

```
                    10        20        30        40        50        60        70        80        90        100       110       120
          ....|....|....|....|....|....|....|....|....|....|....|....|....|....|....|....|....|....|....|....|....|....|....|....|...
P1-061029 EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSS
P1-068757 .............................E.E.......................EE....................................................E.D...........
P1-068759 .............................E.E...................D...E.....................................................E.D...........
P1-068761 .............................E.E.......................EE..............................................H.....E.............
P1-068763 .............................E.....................D...E...............................................H.....E.............
P1-068765 ............................DE.........................EE....................................................E.D...........
P1-068767 .............................E.....................D...E.....................................................E.D...........
P1-068769 .............................E.E.......................DH....................................................E.D...........
P1-068771 .............................E.E.......................HE....................................................E.D...........
P1-068773 .............................E.....................D...D.....................................................E.D...........
P1-068775 .............................E.E...................D...EE..............................................H.....E.D...........
P1-069059 .............................E.........................DH....................................................E.D...........
P1-069061 .............................E..........................E....................................................E.D...........
P1-069063 .............................E..........................E....................................................D.E...........
P1-069065 .............................E.E.......................DD..................................................................
P1-069067 .......................................................EE....................................................D.E...........
P1-069069 .......................................................EE....................................................D.............
P1-069071 .............................E.E........................D..............................................E...................
P1-069073 .............................E.E........................E....................................................E.............
P1-069075 .............................E.......................D..E..............................................H.....E.............
P1-069077 .............................E.E.......................DE..................................................................
P1-069293 .............................E.E.......................EE..............................................H.....E.............
P1-069298 .............................E.....................D...E.....................................................E.D...........
P1-069302 ...........................................................................................................................
P1-069312 .............................E.E.......................EE..............................................H.....E.............
P1-069309 .............................E.....................D...E.....................................................E.D...........
P1-069307 ...........................................................................................................................
P1-070864 ...............................E.......................EE..............................................H.....E.............
P1-070866 .............................E.........................EE..............................................H.....E.............
P1-070868 .............................E.E........................E..............................................H.....E.............
P1-070870 .............................E.E.......................E...............................................H.....E.............
P1-070872 .............................E.E.......................EE....................................................E.............
P1-070874 .............................E.E.......................EE..............................................H...................
P1-070876 .......................................................EE..............................................H.....E.............
P1-070878 .............................E.E.......................................................................H.....E.............
P1-070880 .............................E.E.......................EE..................................................................
P1-070882 .............................E..........................E..............................................H.....E.............
P1-070884 .............................E.........................E...............................................H.....E.............
P1-070886 .............................E.........................EE....................................................E.............
P1-070888 .............................E.........................EE..............................................H...................
P1-070890 ...............................E........................E..............................................H.....E.............
```

```
                  10        20        30        40        50        60        70        80        90       100       110       120
          ....|....|....|....|....|....|....|....|....|....|....|....|....|....|....|....|....|....|....|....|....|....|....|....|.
P1-061015 QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSS
P1-068736 ..............................E...................D.......D............................................D.....D...........
P1-068738 ..............................E..H..................D....H.............................................ED................
P1-068740 ..............................D.........................D.D............................................D.....D...........
P1-068742 ..............................D.........................D.D............................................ED................
P1-068744 ..............................E..................H.........E...........................................E.....E...........
P1-068746 .........................................................HH............................................D.................
P1-068748 ..............................HH.........................DD............................................D.................
P1-068750 ..............................D.D................E..D..............................................EE....................
P1-068752 .................................................E........D............................................D.....E...........
P1-068754 ..............................D.D................E..D.................................................H.D................
```

FIG. 13B

| | | |
|---|---|---|
| 761 | EVQLVESGGGLVQPGKSLRLSCAASGFTLEDEAMHWVRQAPGKGLEWVSGINWNSEEIGYADSVKGRFTISRDNAKNSLY | |
| P1-068761_VH_K16R_T84A | EVQLVESGGGLVQPGRSLRLSCAASGFTLEDEAMHWVRQAPGKGLEWVSGINWNSEEIGYADSVKGRFTISRDNAKNSLY | |
| Column # | 10 20 30 40 50 60 70 80 | |
| 761 | LQMNSLRTEDTALYYCAKVPGYSHGWIDAEDVWGQGTMVTVSS | (SEQ ID NO: 51) |
| P1-068761_VH_K16R_T84A | LQMNSLRAEDTALYYCAKVPGYSHGWIDAEDVWGQGTMVTVSS | (SEQ ID NO: 463) |
| Column # | 90 100 110 120 | |

FIG. 14

VISTA, PD-L1

```
        10         20         30         40         50
MGVPTALEAG SWRWGSLLFA LFLAASLGPV AAFKVATPYS LYVCPEGQNV
        60         70         80         90        100
TLTCRLLGPV DKGHDVTFYK TWYRSSRGEV QTCSERRPIR NLTFQDLHLH
       110        120        130        140        150
HGGHQAANTS HDLAQRHGLE SASDHHGNFS ITMRNLTLLD SGLYCCLVVE
       160        170        180        190        200
IRHHHSEHRV HGAMELQVQT GKDAPSNCVV YPSSSQDSEN ITAAALATGA
```

VISTA Octet Binding Response (nm)

0.5
0.4
0.3
0.2
0.1
0.0
-0.1

6.0
6.5
7.0
7.5 pH

PSGL-1
GP1Ba

VISTA multimer platelet binding pH 7.4, control
pH 6.0, control
pH 6.0, VISTA.4
pH 6.0 unstained VISTA multimer MFI

```
                E31S; X1          H50I; X2          E59Y; X3              E100S; X4
P1-061015   GFTFSSYAMH_IIWYDGSNKYYADSVKG_DSGFYSSYYFDY
P1-068744   .....E...._H.........E......_.....E.....E   E102Y; X5
P1-068748   .....HH..._.........DD......_.....D......
              H31S; X1  H32Y; X2   D57K; X3  D58Y; X4      D100S; X5
```

Fig. 29C

ANTIBODIES BINDING TO VISTA AT ACIDIC PH

This application is a national stage application of International Patent Application No. PCT/US2020/051421, filed Sep. 18, 2020, which claims priority to U.S. Provisional Application Nos. 62/902,741, filed Sep. 19, 2019, and 62/916,690, filed Oct. 17, 2019, each of which is incorporated in their entirety by reference herein.

SEQUENCE LISTING

The present application is filed with a Sequence Listing in electronic format. The Sequence Listing is provided as a file entitled "01275_0065-00PCT ST25" created on Oct. 9, 2020, which is 993,698 bytes in size. The information in the electronic format of the sequence listing is incorporated herein by reference in its entirety.

FIELD

The present application relates to antibodies specifically binding to the V-domain immunoglobulin-containing suppressor of T-cell activation (VISTA) at acidic pH and their use in cancer treatment.

BACKGROUND AND SUMMARY OF THE DISCLOSURE

The V-domain Ig-containing suppressor of T-cell activation, or VISTA, is a co-inhibitory member of the B7 family of immunoreceptors expressed by myelomonocytic cells and other leukocytes. However, the mechanism by which VISTA suppresses immune responses is poorly understood.

The inventors have found that unlike other known immunoreceptors, VISTA engages its counter-receptors and functions selectively at acidic pH, with little activity at physiological pH (e.g., 7.3-7.4). VISTA may thus suppress immune responses in acidic microenvironments, such as tumor beds or sites of inflammation, without perturbing cells circulating in blood or residing in non-inflamed, non-acidic tissues. Additionally, the inventors have found that anti-VISTA antibodies can be engineered to selectively bind to VISTA at acidic pH, with little or no binding at physiological pH, mirroring VISTA's own acidic pH selectivity. These acidic pH selective antibodies may offer desirable properties for treating diseases, such as cancer, relative to antibodies that bind VISTA at physiological pH.

The present disclosure concerns antibodies that specifically bind to the extracellular domain (ECD) of VISTA, such as human VISTA ("hVISTA" or "huVISTA") at acidic pH (e.g., in acidic conditions). The present disclosure also concerns antibodies that specifically bind to the extracellular domain (ECD) of VISTA, such as hVISTA, at acidic pH, with little or no binding at neutral or physiological pH. The inventors have noted herein that the hVISTA-ECD amino acid sequence includes a number of conserved as well as nonconserved histidine residues, and that the frequency of histidine residues in VISTA's ECD is exceptionally high relative to other B7 family members and other Immunoglobulin Superfamily members. (See FIGS. 1A and 1B.) In solution, the amino acid histidine has a $pK_a$ of about 6.5, meaning that at or below pH 6.5, histidine residues within proteins are often protonated and thus, positively charged, while at pH higher than pH 6.5 they are increasingly unprotonated and neutral in charge. Tumor microenvironments and inflamed tissues are often acidic, and thus, VISTA proteins found in these microenvironments may be at least partially protonated at their histidine residues. The inventors, as discussed herein, have hypothesized that histidine protonation may affect the conformation, surface structure, and/or charge density of VISTA, which, in turn, may create pH-specific or pH-selective epitopes for both receptor-ligand interaction(s) and antibody binding. Targeting VISTA with antibodies that bind at acidic pH but not neutral or physiological pH may prevent target-mediated drug disposition via circulating and lymphoid organ-resident myelomonocytic cells, improving antibody PK, receptor occupancy, and activity in tumor microenvironments. Acidic pH-selective antibodies may also improve the specificity of VISTA antibodies for intratumoral, rather than circulating, target cells in the cases of therapeutic modalities such as antibody-dependent cell-mediated cytotoxicity (ADCC), antibody-dependent cellular phagocytosis (ADCP), complement-dependent cytotoxicity (CDC), and delivery of payloads (antibody-drug conjugates).

The present disclosure describes anti-hVISTA Abs including the following: P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, and P1-068748_D57K_D100S. These antibodies may contain the heavy chain CDRs of either P1-068744 or P1-068748 Abs modified to revert at least one H, D, or E residue back to the residue found at the same position in the P1-061015 parental antibody.

More generally, the present disclosure includes anti-hVISTA Abs comprising a heavy chain variable region (VH) comprising a VH CDR1 comprising GFTFS$X_1$YAMH, wherein $X_1$ is E or S (SEQ ID NO: 690); a VH CDR2 comprising $X_2$IWYDGSNKY$X_3$ADSVKG, wherein $X_2$ is H or I, and $X_3$ is E or Y (SEQ ID NO: 691); and/or a VH CDR3 comprising DSGFY$X_4$SYYFD$X_5$, wherein $X_4$ is E or S and $X_5$ is E or Y (SEQ ID NO: 692). (See also FIG. 29C.) In Ab P1-061015, these positions are S, I, Y, S, and Y, respectfully, while in P1-068744, these positions are E, H, E, E and E, respectively. In such cases, the antibody may comprise VH CDR1, CDR2 and/or CDR3 of P1-068744, but with the following, specified reversions back to the positions of P1-61015 (see Tables 11 and 27): P1-068744_E31S (i.e., comprising the CDRs of P1-068744 except that $X_1$ is S), P1-68744_H50I (i.e., $X_2$ is I), P1-68744_E59Y (i.e., $X_3$ is Y), P1-068744_E100S (i.e., $X_4$ is S), P1-068744_E102Y (i.e., $X_5$ is Y), P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, or P1-068744_E59Y_E102Y. Note that the nomenclature of these antibodies used above is based on the Kabat numbering scheme, which numbers residues in part by their structural positions rather than by their sequence positions. As antibodies may have CDRs of different lengths, that numbering scheme may not necessarily correspond to the residue position numbers of the antibody sequence. The above substitutions at $X_1$, $X_2$, $X_3$, $X_4$, and $X_5$ are located at positions 31, 50, 60, 104, and 110 of the heavy chain sequence of SEQ ID Nos: 95 and 103 herein, as can also be seen readily from reviewing Tables 11 and 27. See, e.g, M. Dondelinger et al., Front. Immunol. 9:2278 (2018), for further information regarding antibody residue numbering formats.

In addition, the present disclosure includes anti-hVISTA Abs comprising a heavy chain variable region (VH) comprising a VH CDR1 comprising GFTFSX$_1$X$_2$AMH, wherein $X_1$ is H or S, and $X_2$ is H or Y (SEQ ID NO: 693); a VH CDR2 comprising IIWYDGSNX$_3$X$_4$YADSVKG, wherein $X_3$ is D or K, and $X_4$ is D or Y (SEQ ID NO: 694); and/or a VH CDR3 comprising DSGFYX$_5$SYYFDY, wherein $X_5$ is D or S (SEQ ID NO: 695). (See also FIG. 29C.) In Ab P1-061015, these positions are S, Y, K, Y, and S, respectfully, while in P1-068748, these positions are H, H, D, D and D. In such cases, the antibody may comprise VH CDR1, CDR2 and/or CDR3 of P1-068748, but with the following, specified reversions back to the positions of P1-61015 (see Tables 12 and 28): VH CDR1, CDR2 and/or CDR3 of P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. Note that the nomenclature herein is based on Kabat numbering. The above substitutions at $X_1$, $X_2$, $X_3$, $X_4$, and $X_5$ are located at positions 31, 32, 58, 59, and 104 of the heavy chain sequences of SEQ ID Nos: 95 and 99, as can also be seen from reviewing Tables 12 and 28 and SEQ ID Nos: 95 and 99, for example.

BRIEF DESCRIPTION OF THE FIGURES

FIGS. 1A-C show that VISTA's extracellular domain contains an exceptionally high frequency of histidine residues, that many of these histidine residues are conserved, and that at least some of these histidine residues may participate in receptor-ligand binding. FIG. 1A shows a graph of immunoglobulin domain-containing proteins, with the number of extracellular domain amino acid residues for each protein plotted on the x-axis, and the frequency of histidine residues within the extracellular domain for each protein plotted on the y-axis. The size of each data point corresponds to the total number of histidine residues in each protein's extracellular domain. FIG. 1B shows the aligned amino acid sequences of the extracellular domains of human (SEQ ID NO: 165), cynomolgus macaque (SEQ ID NO: 166), and mouse (SEQ ID NO: 167) VISTA. Signal peptide (Sig) and transmembrane domain (TMD) sequence locations are marked. Histidine residues conserved across all three species are shown in bold and underlined; histidine residues conserved across human and cynomolgus macaque are shown in bold only. FIG. 1C shows a model of the human VISTA immunoglobulindomain's three-dimensional structure. Histidine residues are depicted as ball and stick traces.

FIG. 2A shows the equilibrium between the lack of, and the presence of, protonation of the pyrrole ammonium group (NH) in a histidine residue. The pKa of histidine in solution is 6.5, indicating that histidine residues are more likely to be protonated at pH 6.5 and lower, and thus, positively charged, than at higher pH. FIG. 2B shows shows a model in which VISTA engages P-selectin glycoprotein ligand 1 (PSGL-1) or other counter-receptors and ligands ("VISTA-R") selectively at acidic pH. Accordingly, antibody binding to VISTA's extracellular domain at acidic pH rather than at physiological pH may be critical to inhibiting or modulating VISTA activity.

FIG. 4A on the left shows representative histograms of fluorescently-conjugated recombinant VISTA multimer binding to activated human CD4+ T cells. From darker gray to lighter, the filled histograms depict binding at pH 7.0, 6.5, 6.4, 6.3, 6.1, and 6.0. Some histograms are labeled with their corresponding pH. Non-VISTA control multimer binding at pH 6.0 is shown as the unfilled histogram. On the right, the mean MFI of VISTA (circles) and control (triangles) multimer binding to activated human CD4+ T cells from two donors at different pH is graphed. FIG. 4B shows representative histograms of recombinant VISTA multimer binding to peripheral blood mononuclear cells (PBMC) at pH 6.0 and pH 7.4. From darker gray to lighter, the filled histograms depict binding at pH 6.0 to CD19+ B cells, CD4+ T cells, CD8+ T cells, CD56+ NK cells, and CD14+ monocytes. The unfilled, solid border and dotted border histograms depict binding at pH 7.4 to total PBMC lymphocytes and monocytes respectively. FIG. 4C shows representative recombinant VISTA multimer binding to activated human CD4+ T cells in the presence of an anti-VISTA blocking antibody (squares) or a non-VISTA-specific isotype-matched control antibody (circles). Antibody concentrations are plotted on log scale. Non-linear regressions are also shown. The triangle depicts the background signal from activated human CD4+ T cells that were not stained with recombinant VISTA multimers. FIG. 4D shows representative two-dimensional flow cytometry plots of recombinant VISTA multimer binding at pH 6.0 to heparan sulfate-deficient Chinese Hamster Ovary (CHO) cells (line pGSD-677, American Type Culture Collection) that were transfected to express human PSGL-1. Multimer binding was performed in the presence and absence of the anti-VISTA blocking antibody shown in FIG. 4C. Cells left unstained by recombinant VISTA multimers are shown as a control. PSGL-1 antibody staining is plotted on the y-axis, and VISTA multimer staining is plotted on the x-axis. FIG. 4E shows representative histograms of recombinant mouse VISTA-Fc fusion protein binding to mouse splenocytes at pH 6.0 and pH 7.4. From darker gray to lighter, the filled histograms depict binding at pH 6.0 to CD8+ T cells, CD11b+ myeloid cells, and CD4+ T cells. The unfilled histogram depicts binding at pH 7.4 to total splenocytes. FIGS. 4F and G show that VISTA multimer binds to monocytes and neutrophils, respectively, and does so more strongly at pH 6.0 then at pH 7.4.

FIG. 5A shows representative cell: cell conjugate formation at pH 6.0 and 7.0 between 293T cells expressing hVISTA or vector control (plotted on the y-axes) and CHO cells endogenously expressing cell surface heparan sulfate on the x-axes. FIG. 5B is a graph of the frequency of cell conjugates formed at pH 6.0 between the same cells in the presence of an anti-VISTA blocking antibody, an anti-VISTA non-blocking antibody, or isotype-matched non-VISTA-specific control antibodies. FIG. 5C shows representative plots of the luciferase activity generated by Jurkat (human T cell line) cells expressing an NFkB luciferase reporter after co-culture at various pH with 293T cells expressing h VISTA and a single-chain variable fragment of the anti-human T cell receptor agonist antibody OKT3 ("artificial antigen-presenting cells"). An anti-VISTA blocking antibody (squares) or an isotype-matched non-VISTA-specific control antibody (circles) were added to the co-cultured cells. In FIG. 5D, the data shown in FIG. 5A are plotted as fold-increase of the luciferase signal with anti-VISTA antibody treatment relative to control ("effect size").

FIG. 6A shows co-localization of VISTA, Rab5 (early endosome marker), Rab7 (late endosome marker), and Rab11 (recycling endosome marker) within 293T cells expressing human VISTA. FIG. 6B shows co-localization of VISTA and Rab11 within human monocytes. Intracellular VISTA is co-localized with Rab11+ recycling endosomes. A non-VISTA-binding control antibody of the same isotype as the VISTA antibody ("cAb") does not detectably bind the monocytes. FIG. 6C shows the binding of three anti-VISTA antibodies to recombinant VISTA at pH 7.4 (black), 6.7 (darker gray), and 6. (lighter gray). FIG. 6D shows the susceptibility of a VISTA expressing acute myeloid leukemia (AML) cell line to killing by the same anti-VISTA antibodies 1 (inverted triangles), 2 (circles), 3 (squares), or a non-VISTA-specific control antibody (triangles) bearing cathepsin B-sensitive linkers and cytotoxic payloads. Cell viability (CellTiter-Glo LU) is plotted on the y-axis and antibody concentrations are plotted on the x-axis. FIG. 6E compares hVISTA binding of anti-VISTA antibody 3 to that of an engineered variant ("VISTA mAb 3c") that does not exhibit impaired binding at acidic pH. FIG. 6F shows an antibody drug-conjugate assay comparing the potency of anti-VISTA antibody 3 (squares) and 3c (diamonds). FIG. 6G shows a schematic of endosome trafficking, with VISTA recycling to and from and cell surface via early endosomes and recycling endosomes.

FIG. 7A (SEQ ID NOS: 168-181, 696-737, respectively) shows amino acid substitutions that were made in VH CDR 3 of the anti-human VISTA antibody clone P1-061029 (abbreviated '029) for creating an '029 library for screening. To potentially improve binding to VISTA's histidine-rich region at acidic pH, the libraries allowed substitutions for the negatively charged amino acids aspartate and glutamate as well as pH-responsive histidine. X=H, D or E. Bracketed sequences were removed from synthesis to avoid introducing liabilities. A total of 647 unique sequences of P1-061029 HCDR3 with 1-2 mutations were synthesized. FIG. 7B shows the procedure by which the '029 library is iteratively screened and selected for acidic pH-selective antibody variants. R denotes selection round. FIG. 7C shows representative two-dimensional flow cytometry plots data showing the variant pool after 9 rounds of selection. VISTA binding is plotted on the y-axis, and variant antibody expression is plotted on the x-axis. Binding data at various antibody concentrations and pH are shown. FIG. 7D shows a diagram of P1-061029 and its progeny clones binding to human VISTA at pH 6.0 and 7.4. FIG. 7E shows a diagram of the off-rates of P1-061029 and its progeny clones to human VISTA at pH 6.0. FIG. 7F shows SPR binding data of the antibodies P1-068761, P1-068767 and P1-061029 to human VISTA at pH 6.0 and pH 7.4.

FIG. 8A and FIG. 8B show the mean fluorescence intensity of the acidic pH-selective antibodies P1-068761 (FIG. 8A) and P1-068767 (FIG. 8B) binding to Raji cells ectopically expressing human VISTA. The cells were stained at approximately pH 6.0 (circles; highest curve in FIG. 8A), 6.1 (squares; third highest curve), 6.2 (triangles; second highest curve), 6.4 (inverted triangles; fourth highest curve close to the pH 6.1 curve), 6.6 (diamonds; fourth curve from bottom), 7.0 (circles; third curve from bottom), 7.2 (squares; second curve from bottom), and 8.1 (unfilled triangles; bottom curve in FIG. 8A). Binding was detected with a fluorescently conjugated anti-human IgG secondary antibody. FIG. 8C shows P1-068767 (circles) and an isotype-matched non-specific control antibody (triangles) binding to Raji cells ectopically expressing human VISTA at 3125 ng/ml at various pH. The "$pH_{50}$", the pH at which 50% of P1-068767 binding is lost, is approximately 6.6. FIG. 8D shows the mean fluorescence intensities (MFI) of an isotype-matched non-specific control antibody (filled and unfilled circles for pH 7.0 and 6.0 respectively), anti-VISTA mAb 2 ("control", see FIG. 6C, filled and unfilled squares at pH 7.0 and 6.0 respectively), P1-068761 (filled and unfilled triangles for pH 7.0 and 6.0 respectively), and P1-068767 (filled and unfilled inverted triangles for pH 7.0 and 6.0 respectively) binding to human monocytes. Binding was detected by a fluorescently conjugated anti-human IgG secondary antibody. FIG. 8E shows the comparable blocking of recombinant VISTA multimer binding to activated human CD4+ T cells at pH 6.0 by P1-061029 (squares), P1-068761 (triangles), and P1-068767 (inverted triangles), while a non-VISTA-specific control antibody (circles) did not block VISTA binding. FIG. 8F shows the reduced potency of P1-068761 (triangles) and P1-068767 (inverted triangles) in mediating antibody-dependent cell cytotoxicity (ADCC) at physiological pH. P1-061029 (squares), a non-VISTA-specific positive control antibody (circles), and a non-VISTA-specific negative control antibody (diamonds) are also shown. NK cell specific lysis of target cells as a percentage of total target cells is plotted on the y-axis and antibody concentrations are plotted on the x-axis. Non-linear regressions are also shown.

FIGS. 10A and 10B (P1-061029-pos 26-35, pos 50-66, pos 99-110 of SEQ ID NO: 67) show the binding effects of mutations in the acidic pH-selective anti-VISTA antibodies '761 and '767. FIG. 10A shows kinetic binding data of P1-068761 reversion mutants at pH 7.4, pH 6.7 and pH 6.0 and the location of their reversion mutations relative to P1-068761. FIG. 10B shows kinetic binding data of P1-068767 reversion mutants at pH 7.4, pH 6.7 and pH 6.0 and the location of their reversion mutations relative to P1-068767.

FIG. 11A shows the VISTA epitope competition for P1-068761 and P1-068767 compared to P1-061029 and VISTA antibody controls. FIG. 11B and FIG. 11C show representations of the epitopes of all the residues for blocking hVISTA antibody (FIG. 11B) as listed in Table 14 compared to a non-blocking hVISTA antibody (mAb1; FIG. 11C). Amino acid residues 66 (H) and 162 (A) are indicated to denote the orientation of the molecule. Histidine residues are in grey, and epitope residues are in black.

FIG. 12A: P1-061029, FIG. 12B: P1-068761, and FIG. 12C: P1-068767. The isoelectric point of the main species (pI main) as well as pI markers are indicated.

Figure 13A:
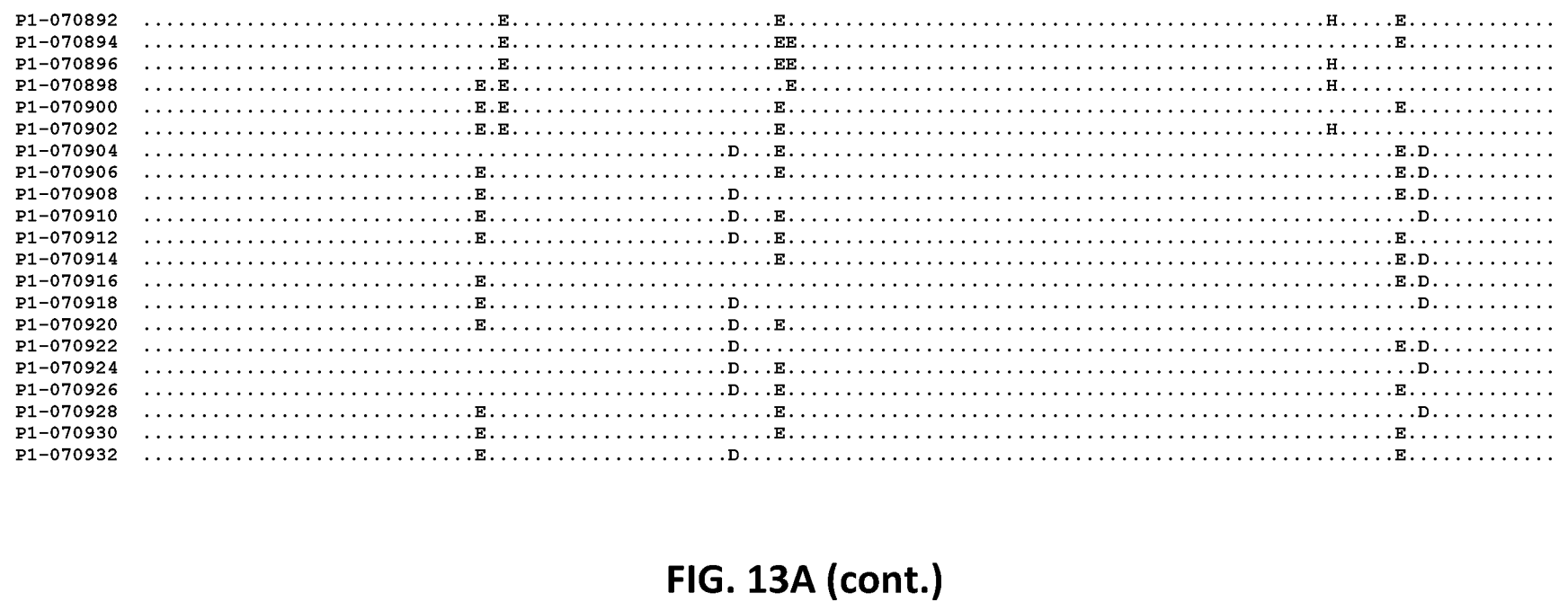

FIGS. 13A and B show alignments of variable regions for '029 and '015 progeny clones. FIG. 13A (SEQ ID NO: 67) shows the alignment of the amino acid sequences of the variable regions of '029 and its progeny clones. FIG. 13B (SEQ ID NO: 95) shows the alignment of the amino acid sequences of the variable regions of '015 and its progeny clones.

FIG. 14 shows an alignment of VH sequences of P1-068761 with and without K16R and T84A substitutions. The double-underlined residues show positions 16 and 84 of the framework regions and the shaded portions show the CDRs.

FIGS. 15A-D show the tumor volumes over time. n=10 per group. "TF" denotes mice that rejected their tumors. FIG. 15O shows Cynomolgus macaque serum antibody concentrations after intravenous injection of 5 mg/kg of VISTA.4 (circles) or P1-068767 (squares). The calculated serum mean residence times (MRT) for VISTA.4 and P1-061029 are estimated to be 7.6 hours and 717 hours respectively. n=1 macaque per antibody. These data are representative of a single experiment. Error bars depict the standard error of the mean where not otherwise indicated.

FIG. 17A shows BLI binding sensorgrams for P-Selectin-Fc and VISTA-Fc binding to captured PSGL1 at pH 6.0 and pH 7.4. FIG. 17B is a histogram showing that antibodies P1-061029, P1-068761, P1-068767 and VISTA.4 inhibit binding of PSGL-1 to hVISTA. FIG. 17C shows antibody blockade of VISTA-Fc binding to CHO-PSGL-1 cells by VISTA.4 (upward triangles) and by the anti-PSGL-1 antibody KPL-1 (circles). These data are representative of two independent experiments. Error bars depict the standard error of the mean.

FIG. 18A shows VISTA IgV domain: P1-068767 Fab co-crystal structure. FIG. 18A shows the overall structure of the VISTA IgV domain in complex with the P1-068767 Fab (heavy chain, dark gray; light chain, light gray). FIG. 18B shows a superimposition of the VISTA and PD-L1 IgV domains. VISTA histidine residues are depicted in stick representation. FIG. 18B shows that VISTA's IgV domain possesses an unusual histidine-rich β-sheet extension. FIG. 18C shows the molecular surface of the P1-068767 epitope (light grey electrostatic surface) as revealed by the VISTA+P1-068767 crystal structure. FIG. 18C shows that blocking antibodies bind to VISTA's histidine-rich β-sheet extension. FIG. 18D shows an enlarged view of the interface between VISTA (grey ribbon cartoon, with epitope residues H121, H122, and H123 depicted in stick representation) and P1-068767 (depicted as an electrostatic surface with its residues E100 and D102 in stick representation). FIG. 18D shows that acidic pH-selective P1-068767 engages VISTA histidines with acidic residues. FIG. 18E shows that non-blocking antibody VISTA.5 binds in a different region of hVISTA from P1-068767.

FIG. 21B shows the blocking efficiency of each antibody relative to non-blocked T cells. One-way ANOVA with Dunnett's multiple comparisons, ***, $P<0.001$. These data are representative of more than four independent experiments. Error bars depict the standard error of the mean.

As shown in FIG. 25A, human PSGL-1 19-mer-Fc recombinant proteins were produced in cells with or without sialyl lewis X decoration (SLX+ and SLX-respectively). BLI binding magnitudes at pH 6.0 (white) and 7.4 (black) are shown for VISTA-Fc and P-selectin-Fc as indicated. Data are representative of a single independent experiment. As shown in FIG. 25B, human PSGL-1 19-mer-Fc glycopeptides produced with sialyl lewis X decoration were separated into fractions with greater than 90% tyrosine sulfation (sY-rich) and less than 1% tyrosine sulfation (sY-poor). BLI binding magnitudes at pH 6.0 (white) and 7.4 (black) are shown for VISTA-Fc and P-selectin-Fc as indicated. These data are representative of a single independent experiment. As provided in FIGS. 25C-25D, human VISTA-Fc recombinant proteins were produced with the histidine residues at positions 153-155 left intact (WT VISTA) or replaced by alanine (H2A mutant), aspartic acid (H2D mutant), or arginine (H2R mutant). FIG. 25C shows BLI binding magnitudes for wildtype and mutant VISTA-Fc proteins binding to captured PSGL-1 at pH 6.0 and 7.4. These data are representative of a single experiment. FIG. 25D shows VISTA-Fc binding to CHO-PSGL-1 cells at pH 6.0 of WT VISTA (circles), H2A mutant (squares), H2D mutant (downward triangles), and H2R mutant (grey upward triangles), as well as a control (diamonds). These data are representative of two independent experiments. FIG. 25E shows a computational model of the PSGL-1 19-mer glycopeptide (top) in complex with VISTA's histidine-rich ligand interface (grey ribbons, bottom). VISTA residues H98, H100, H153, and H154 are marked. PSGL-1 residues Y46, Y48, E56, T57, and Y58 are also marked.

FIG. 26A shows BLI binding magnitudes for GP1BA-his (squares) and PSGL-1 19-mer-Fc (circles) to captured VISTA-Fc at the indicated pH. These data are representative of one experiment. FIG. 26B shows VISTA multimer binding histograms to human platelets. Binding was performed in the presence of non-VISTA-binding control antibodies at pH 7.4 and pH 6.0, or the VISTA.4 blocking antibody at pH 6.0. Unstained platelets (gray filled histogram) are also shown. These data are representative of two independent experiments. FIG. 26C shows BLI binding magnitudes for VSIG-3-Fc binding to captured VISTA-Fc at the indicated pH. These data are representative of two independent experiments. FIG. 26D shows BLI binding magnitudes of VSIG-3-Fc at the indicated concentrations binding to captured VISTA-Fc at pH 6.0. Competition was provided by buffer alone (far left bars), non-binding isotype matched control antibody, human PSGL-1 19-mer-Fc, P1-061029, P1-061767, or VISTA.5 (far right). These data are representative of one independent experiment. FIG. 26E shows VSIG-3-Fc binding to activated human PBMC T cells at pH 6.0 (circles) or pH 7.4 (squares). Binding of isotype-matched control antibody at pH 6.0 (black diamond) and pH 7.4 (gray triangle) is also shown. These data are representative of two independent experiments. Error bars depict the standard error of the mean. FIG. 26F shows BLI binding magnitudes for VISTA-Fc (left) and PSGL-1 19-mer-Fc (right) binding to captured VISTA-Fc at the indicated pH. These data are representative of one independent experiment.

FIGS. 27A-D show human and cynomolgus macaque sensorgrams for the antibodies VISTA.4 and P1-068767 at pH 7.4 (left) and pH 6.0 (right). These data are representative of two independent experiments. FIG. 27A: Human VISTA sensorgrams for VISTA.4. FIG. 27B: Human VISTA sensorgrams for P1-068767. FIG. 27C: Cynomolgus macaque VISTA sensorgrams for VISTA.4. FIG. 27D: Cynomolgus macaque VISTA sensorgrams for P1-068767. FIG. 27E shows levels of labeled P1-061029 or P1-068767 antibodies in various organs, blood or tumor in human VISTA knock-in mice that were implanted with MC38 tumors, and treated with the respective antibodies. FIG. 27F shows tumor growth in mice treated with P1-061029 only (left, downward triangles) or with P1-068767 only (right, upward triangles). n=16 per group. These data are a composite of two independent experiments. Error bars depict the standard error of the mean.

FIG. 29A-C show results from SPR assays of the binding of anti-h VISTA antibodies to hVISTA. FIG. 29A shows relative hVISTA binding (% Rmax) at pH 6.0 (black bars) and pH 7.4 (grey bars) by SPR of P1-068744 reversion mutants compared to binding of the parental P1-061015 antibody. FIG. 29B shows relative hVISTA binding (% Rmax) at pH 6.0 (black bars) and pH 7.4 (grey bars) by SPR of P1-068748 reversion mutants compared to binding of the parental P1-061015 antibody. FIG. 29C (pos. 26-35, 50-66, 99-110 of SEQ ID NO: 95) shows a summary of the results as an alignment of the antibody heavy chain CDRs. The deliniated amino acid residues of P1-068744 and P1-068748 that are bolded are those whose reversion back to the corresponding residues in P1-061015 maintained pH selectivity and improved the ka at pH 6.0 compared to the P1-068744 or P1-068748 antibody. The amino acid residues that have a double underline are those whose reversion back to the corresponding residues in P1-061015 caused a loss of pH selectivity of P1-068744 or P1-068748, and are therefore important residues in these antibodies for pH selective binding to hVISTA. The amino acid residues with jagged underlining are those whose reversion back to the corresponding residues in P1-061015 was detrimental to kinetics and/or binding of P1-068744 or P1-068748 to hVISTA, and are therefore important residues in these antibodies for binding to hVISTA. Alternate names of the delineated amino acid residues in P1-068744 and P1-068748 antibodies are shown.

FIGS. 30A, 30B, 30C, and 30D each show results for a specific set of antibodies, as shown below each bar graph.

DETAILED DESCRIPTION

Definitions

Figure 1A:
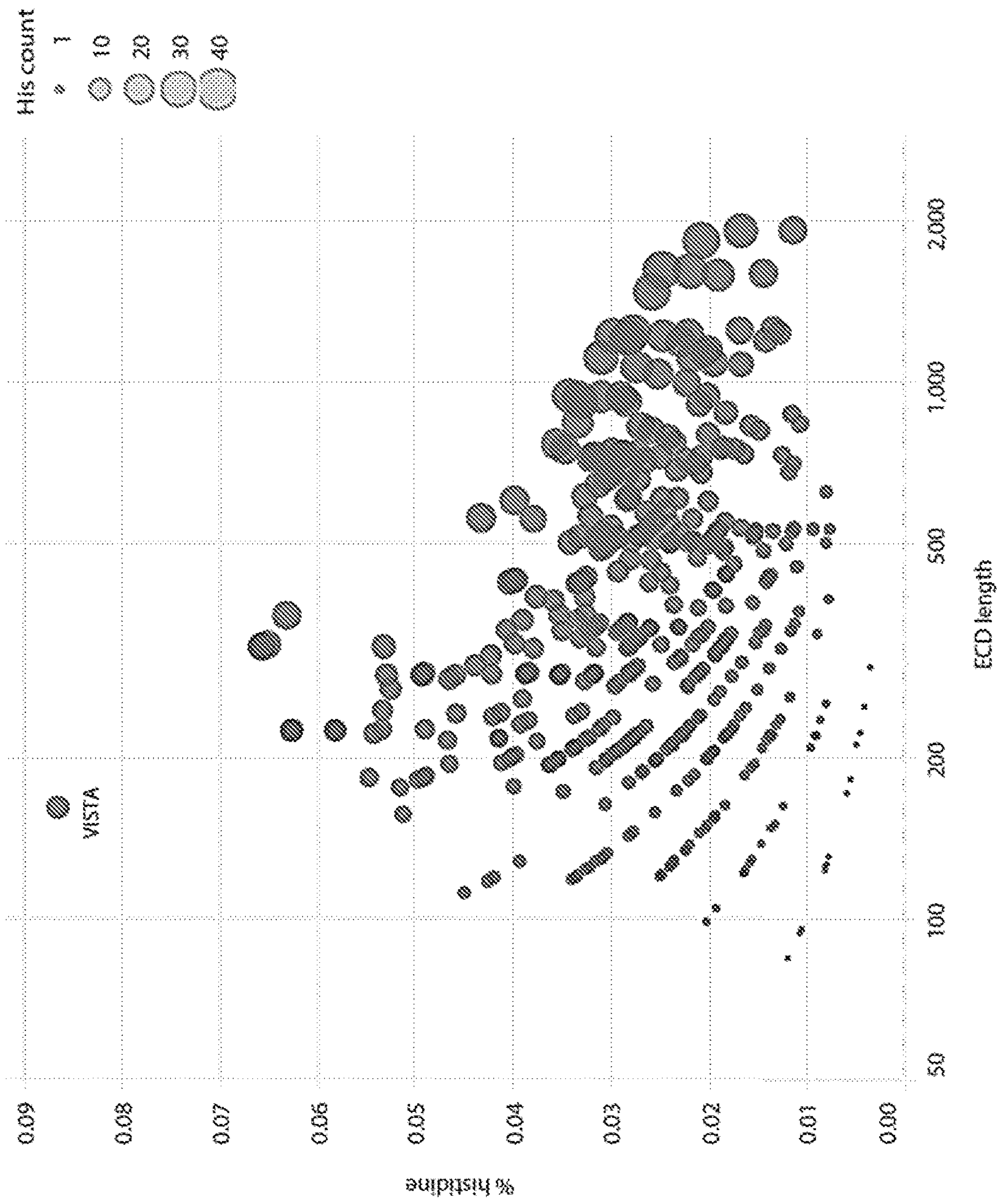

In this application, the use of "or" means "and/or" unless stated otherwise. In the context of a multiple dependent claim, the use of "or" refers back to more than one preceding independent or dependent claim in the alternative only. The terms "comprising," "including," and "having" can be used interchangeably herein. According to the present invention, an "isolated" molecule is a molecule that has been removed from its natural milieu. As such, the term "isolated" does not necessarily reflect the extent to which the molecule has been purified.

The term "polypeptide" refers to a polymer of amino acid residues, and is not limited to a minimum length. A "protein" may comprise one or more polypeptides. Such polymers of amino acid residues may contain natural or non-natural amino acid residues, and include, but are not limited to, peptides, oligopeptides, dimers, trimers, and multimers of amino acid residues. Both full-length proteins and fragments thereof are encompassed by the definition. The terms also include post-expression modifications of the polypeptide, for example, glycosylation, sialylation, acetylation, phosphorylation, and the like. Furthermore, for purposes of the present invention, a "polypeptide" or "protein" refers to a polypeptide or protein, respectively, which includes modifications, such as deletions, additions, and substitutions (generally conservative in nature), to the native sequence, as long as the protein maintains the desired activity. These modifications may be deliberate, as through site-directed mutagenesis, or may be accidental, such as through mutations of hosts that produce the proteins or errors due to PCR amplification. A protein may comprise two or more polypeptides.

"VISTA" is an abbreviation for the V-domain immunoglobulin-containing suppressor of T-cell activation protein, which is a member of the B7 family of immune checkpoint regulators. VISTA is also known as the PD-1 homolog (PD1H), B7-H5, C10orf54, differentiation of ESC-1 (Dies-1), platelet receptor Gi24 precursor, and death domain 1α (DD1α). The term "hVISTA" or "huVISTA" herein refers to the human VISTA protein. The amino acid sequence of hVISTA, including its signal peptide is provided in SEQ ID NO: 1, while the sequence without the signal peptide is provided in SEQ ID NO:2. (See the Sequence Table below.) The extracellular domain or "ECD" of VISTA or the "VISTA-ECD" refers to the portion of the VISTA protein that is located in the extracellular space, which, in the case of hVISTA, comprises the amino acids 1-162 of SEQ ID NO:2. (See also FIG. 1B.) The "IgV domain" portion of hVISTA comprises residues 5-135 of SEQ ID NO:2. The term "leader peptide" or "leader sequence" refers to a sequence of amino acid residues located at the N terminus of a polypeptide that facilitates secretion of a polypeptide from a mammalian cell. A leader sequence may be cleaved upon export of the polypeptide from the mammalian cell, forming a mature protein. Leader sequences may be natural or synthetic, and they may be heterologous or homologous to the protein to which they are attached.

The term "antibody" or "Ab" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity. As used herein, the term refers to a molecule comprising at least complementarity-determining region (CDR) 1, CDR2, and CDR3 of a heavy chain and at least CDR1, CDR2, and CDR3 of a light chain, wherein the molecule is capable of binding to antigen. The term antibody includes, but is not limited to, fragments that are capable of binding antigen, such as Fv, single-chain Fv (scFv), Fab, Fab', and $(Fab')_2$. The term antibody also includes, but is not limited to, chimeric antibodies, humanized antibodies, human antibodies, and antibodies of various species such as mouse, cynomolgus monkey, etc.

The term "heavy chain" or "HC" refers to a polypeptide comprising at least a heavy chain variable region, with or without a leader sequence. In some embodiments, a heavy chain comprises at least a portion of a heavy chain constant region. The term "full-length heavy chain" refers to a polypeptide comprising a heavy chain variable region and a heavy chain constant region, with or without a leader sequence, and with or without a C-terminal lysine (K).

The term "heavy chain variable region" or "VH" refers to a region comprising a heavy chain complementary determining region (CDR) 1, framework region (FR) 2, CDR2, FR3, and CDR3 of the heavy chain. In some embodiments, a heavy chain variable region also comprises at least a portion of an FR1 and/or at least a portion of an FR4. As specified below, in some embodiments, a heavy chain CDR1 comprises residues 26-35 of a VH SEQ ID NO herein; a heavy chain CDR2 comprises residues 50-66 of a VH SEQ ID NO herein, and a heavy chain CDR3 comprises residues 99-110 of a VH SEQ ID NO herein. In other embodiments, if specified, a heavy chain CDR1 corresponds to Kabat residues 31 to 35; a heavy chain CDR2 corresponds to Kabat residues 50 to 65; and a heavy chain CDR3 corresponds to Kabat residues 95 to 102. See, e.g., Kabat Sequences of Proteins of Immunological Interest (1987 and 1991, NIH, Bethesda, Md.). In some embodiments the heavy chain CDRs are as specified herein, such as in the sequence table below or in Table 2.

The term "light chain" or "LC" refers to a polypeptide comprising at least a light chain variable region, with or without a leader sequence. In some embodiments, a light chain comprises at least a portion of a light chain constant region. The term "full-length light chain" refers to a polypeptide comprising a light chain variable region and a light chain constant region, with or without a leader sequence.

The term "light chain variable region" or "VL" refers to a region comprising a light chain CDR1, FR2, HVR2, FR3, and HVR3. In some embodiments, a light chain variable region also comprises an FR1 and/or an FR4. As specified below, in some embodiments, a light chain CDR1 comprises residues 24-35 of a VL SEQ ID NO herein; a light chain CDR2 comprises residues 51-57 of a VL SEQ ID NO herein, and a light chain CDR3 comprises residues 90-98 of a VL SEQ ID NO herein. In other embodiments, if specified, a light chain CDR1 corresponds to Kabat residues 24 to 34; a light chain CDR2 corresponds to Kabat residues 50 to 56; and a light chain CDR3 corresponds to Kabat residues 89 to 97. See, e.g., Kabat Sequences of Proteins of Immunological Interest (1987 and 1991, NIH, Bethesda, Md.). In some embodiments, the light chain CDRs are as specified herein such as in the sequence table.

A "chimeric antibody" refers to an antibody in which a portion of the heavy and/or light chain is derived from a particular source or species, while the remainder of the heavy and/or light chain is derived from a different source or species. In some embodiments, a chimeric antibody refers to an antibody comprising at least one variable region from a first species (such as mouse, rat, cynomolgus monkey, etc.) and at least one constant region from a second species (such as human, cynomolgus monkey, etc.). In some embodiments, a chimeric antibody comprises at least one mouse variable region and at least one human constant region. In some embodiments, a chimeric antibody comprises at least one cynomolgus variable region and at least one human constant region. In some embodiments, all of the variable regions of a chimeric antibody are from a first species and all of the constant regions of the chimeric antibody are from a second species.

A "humanized antibody" refers to an antibody in which at least one amino acid in a framework region of a non-human variable region has been replaced with the corresponding amino acid from a human variable region. In some embodiments, a humanized antibody comprises at least one human constant region or fragment thereof. In some embodiments, a humanized antibody is an Fab, an scFv, a (Fab') 2, etc.

A "human antibody" as used herein refers to antibodies produced in humans, antibodies produced in non-human animals that comprise human immunoglobulin genes, such as XenoMouse®, and antibodies selected using in vitro methods, such as phage display, wherein the antibody repertoire is based on a human immunoglobulin sequences.

A "VISTA antibody" or "anti-VISTA antibody" as used herein refers to an antibody that specifically binds to VISTA under at least some conditions such as acidic pH. In some embodiments, the antibody may be a "huVISTA antibody" or an "anti-huVISTA antibody" indicting that it specifically binds to the human VISTA protein under at least some conditions such as at acidic pH. A VISTA antibody that specifically binds to the extracellular domain (ECD) of VISTA, for example, may be termed a "VISTA-ECD antibody."

In some embodiments, an antibody herein may contain one or more "conservative substitutions" compared to a particular, specified sequence. "Conservative amino acid substitutions" herein refer to substitutions of an amino acid residue with an amino acid residue having a similar side chain. Families of amino acid residues having similar side chains include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In certain embodiments, a predicted nonessential amino acid residue in an antibody herein is replaced with another amino acid residue from the same side chain family (e.g., basic, acidic, beta-branched, aromatic, uncharged polar). Methods of identifying nucleotide and amino acid conservative substitutions which do not eliminate antigen binding have been described, for example, in Brummell et al., *Biochem.* 32: 1180-1187 (1993); Kobayashi et al. *Protein Eng.* 12(10): 879-884 (1999); and Burks et al. *Proc. Natl. Acad. Sci. USA* 94:412-417 (1997)).

In some embodiments, an antibody may bind with higher affinity to VISTA at acidic pH than at neutral and/or physiological pH. In some embodiments, the antibody may bind with higher affinity to VISTA at acidic pH and may only bind negligibly or nonspecifically at neutral and/or physiological pH.

A "$K_D$" or "dissociation constant" for binding of an antibody to a protein, e.g., a VISTA-ECD protein is a measure of the affinity or specific binding of the antibody to the protein, e.g., VISTA-ECD protein. A lower $K_D$ indicates improved binding or affinity over a higher $K_D$. A $K_D$ is composed of a ratio between an "off-rate" or $k_{off}$ or $k_d$ and an "on-rate" or $k_{on}$ or $k_a$ for the antibody and polypeptide. The off-rate and on-rate are the rates at which the two binding partners associate and dissociate in the system. Thus, a slower off-rate, where the on-rate remains roughly constant, leads to higher overall affinity and thus a lower $K_D$. As used herein, a $k_{off}$ of a particular value "or less" indicates that the $k_{off}$ or "off-rate" is as specified or is slower than the rate specified.

The terms "specific binding" or "specifically binds" or like terms signify that the $K_D$ for the binding of two polypeptides, such as an antibody and its polypeptide target, is less than would be the case between two random polypeptides existing under the same conditions. In other words, the $K_D$ is less than that due to nonspecific aggregation of polypeptides in the system.

In some embodiments, the antibodies specifically bind to a VISTA-ECD protein at a particular pH or pH range. An "acidic" pH herein generally refers to a pH less than 7.0, a "basic" pH generally refers to a pH higher than 7.0 and a "neutral" pH generally refers to a pH of about 7.0. A "physiological pH" herein refers to a pH in normal (i.e., non-cancerous) physiological conditions, e.g., from 7.35 to 7.45, or from 7.3 to 7.4, such as of about 7.4. Phrases such as "binding in acidic conditions" or "binding in physiological conditions" and the like herein, used in the context of binding of two molecules such as VISTA and a VISTA binding partner or VISTA and a T cell, refer to binding in acidic pH and binding in physiological pH, respectively.

When referring to an antibody that "blocks binding of" or "inhibits binding of" a ligand (or receptor) or a competing antibody to a receptor (or ligand) alone or on a cell, binding is blocked if there is an overall decrease that is statistically significant compared to a control, e.g., an overall decrease of 50% or greater, e.g., an overall decrease of 75%, 80%, 85%, 90%, 95%, or greater. An "anti-VISTA blocking antibody," for example, is one that can block binding of VISTA to PSGL-1 or another VISTA ligand or receptor or heparan sulfate proteoglycans under at least some conditions such as at acidic pH.

"Preferably accumulates" or "preferably accumulates" when referring to accumulation of an antibody in tumors in a patient administered with the antibody relative to that in organ or tissue, such as blood, of the patient refers to at least a 50%, 75%, 100% (i.e., 2 fold), 5 fold or more accumulation in tumors relative to that in an organ or tissue. For example, an acid pH selective binding antibody accumulates to at least two fold higher levels in tumors of a subject relative to its accumulation in the blood.

A "tumor model," as used herein, refers to an in vivo preclinical assay, which may be used for studying the biological activity of a VISTA-ECD antibody, and includes xenograft or native mouse tumor assay systems. In some cases, a tumor model may allow for tracking of tumor size or growth upon treatment with the antibody, and/or tracking of the presence of immune cells in the tumor, such as specific types of T-cells or NK cells, in order to determine whether an antibody has triggered or enhanced an immune response.

The term "immune stimulating agent" as used herein refers to a molecule that stimulates the immune system by either acting as an agonist of an immune-stimulatory molecule, including a co-stimulatory molecule, or acting as an antagonist of an immune inhibitory molecule, including a co-inhibitory molecule. The immune-stimulatory molecule or immune inhibitory molecule may be an immune checkpoint regulator such as VISTA or another B7 family member or another molecule as described further below. An immune stimulating agent may be a biologic, such as an antibody or antibody fragment, other protein, or vaccine, or may be a small molecule drug. An "immune stimulatory molecule" includes a receptor or ligand that acts to enhance, stimulate, induce, or otherwise "turn-on" an immune response. Immune stimulatory molecules as defined herein include co-stimulatory molecules. An "immune inhibitory molecule" includes a receptor or ligand that acts to reduce, inhibit, suppress, or otherwise "turn-off" an immune response. Immune inhibitory molecules as defined herein include co-inhibitory molecules. Such immune stimulatory and immune inhibitory molecules may be, for example, receptors or ligands found on immune cells such as a T cells, or found on cells involved in innate immunity such as NK cells.

"Percent (%) amino acid sequence identity" and "homology" with respect to a peptide, polypeptide or antibody sequence are defined as the percentage of amino acid residues in a candidate sequence that are identical with the amino acid residues in the specific peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MEGALIGN™ (DNASTAR) software. Those skilled in the art can determine appropriate parameters for measuring alignment, including any algorithms needed to achieve maximal alignment over the full length of the sequences being compared.

The terms "trigger" or "enhance" refer to an initiation or increase of any event (such as protein ligand binding) or to an initiation or increase of any biological activity (such as an immune response) or phenotypic characteristic or to the initiation or increase in the incidence, degree, or likelihood of that activity or characteristic. To "trigger" or "enhance" is to begin or increase an activity, function, and/or amount as compared to a reference. It is not necessary that the triggering or enhancement be complete. For example, in certain embodiments, by "enhance" is meant the ability to cause an overall increase of 20% or greater. In another embodiment, by "enhance" is meant the ability to cause an overall increase of 50% or greater. In yet another embodiment, by "enhance" is meant the ability to cause an overall increase of 75%, 85%, 90%, 95%, or greater.

The terms "inhibition" or "inhibit" more generally refer to a decrease or cessation of any event (such as protein ligand binding) or to a decrease or cessation of any phenotypic characteristic or to the decrease or cessation in the incidence, degree, or likelihood of that characteristic. To "reduce" or "inhibit" is to decrease, reduce or arrest an activity, function, and/or amount as compared to a reference. It is not necessary that the inhibition or reduction be complete. For example, in certain embodiments, by "reduce" or "inhibit" is meant the ability to cause an overall decrease of 20% or greater. In another embodiment, by "reduce" or "inhibit" is meant the ability to cause an overall decrease of 50% or greater. In yet another embodiment, by "reduce" or "inhibit" is meant the ability to cause an overall decrease of 75%, 85%, 90%, 95%, or greater.

"Treatment" as used herein, covers any administration or application of a therapeutic for disease in a human, and includes inhibiting the disease or progression of the disease or one or more disease symptoms, inhibiting or slowing the disease or its progression or one or more of its symptoms, arresting its development, partially or fully relieving the disease or one or more of its symptoms, or preventing a recurrence of one or more symptoms of the disease.

The terms "subject" and "patient" are used interchangeably herein to refer to a human.

The term "effective amount" or "therapeutically effective amount" refers to an amount of a drug effective for treatment of a disease or disorder in a subject, such as to partially or fully relieve one or more symptoms. In some embodiments, an effective amount refers to an amount effective, at dosages and for periods of time necessary, to achieve the desired therapeutic or prophylactic result.

The term "cancer" is used herein to refer to a group of cells that exhibit abnormally high levels of proliferation and growth. A cancer may be benign (also referred to as a benign tumor), pre-malignant, or malignant. Cancer cells may be solid cancer cells or leukemic cancer cells. The term "tumor growth" is used herein to refer to proliferation or growth by a cell or cells that comprise a cancer that leads to a corresponding increase in the size or extent of the cancer.

Examples of cancers applicable to methods of treatment herein include but are not limited to, carcinoma, lymphoma, blastoma, sarcoma, and leukemia. More particular nonlimiting examples of such cancers include squamous cell cancer, small-cell lung cancer, pituitary cancer, esophageal cancer, astrocytoma, soft tissue sarcoma, non-small cell lung cancer (including squamous cell non-small cell lung cancer), adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, renal cell carcinoma, liver cancer, prostate cancer, vulval cancer, thyroid cancer, hepatic carcinoma, brain cancer, endometrial cancer, testis cancer, cholangiocarcinoma, gallbladder carcinoma, gastric cancer, melanoma, and various types of head and neck cancer (including squamous cell carcinoma of the head and neck).

Administration "in combination with" one or more further therapeutic agents includes simultaneous (concurrent) and consecutive (sequential) administration in any order.

A "pharmaceutically acceptable carrier" refers to a non-toxic solid, semisolid, or liquid filler, diluent, encapsulating material, formulation auxiliary, or carrier conventional in the art for use with a therapeutic agent that together comprise a "pharmaceutical composition" for administration to a subject. A pharmaceutically acceptable carrier is non-toxic to recipients at the dosages and concentrations employed and is compatible with other ingredients of the formulation. The pharmaceutically acceptable carrier is appropriate for the formulation employed. For example, if the therapeutic agent is to be administered orally, the carrier may be a gel capsule. If the therapeutic agent is to be administered subcutaneously, the carrier ideally is not irritable to the skin and does not cause injection site reaction.

A "chemotherapeutic agent" is a chemical compound useful in the treatment of cancer. Examples of chemotherapeutic agents that can be administered in methods herein include, but are not limited to, alkylating agents such as thiotepa and Cytoxan® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammalI and calicheamicin omegaI1 (see, e.g., *Agnew, Chem Intl. Ed. Engl.,* 33:183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, Adriamycin® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, OR); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., Taxol® paclitaxel (Bristol-Myers Squibb Oncology, Princeton, N.J.), Abraxane® Cremophor-free, albumin-engineered nanoparticle formulation of paclitaxel (American Pharmaceutical Partners, Schaumberg, Illinois), and Taxotere® doxetaxel (Rhône-Poulenc Rorer, Antony, France); chloranbucil; Gemzar® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; Navelbine® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluorometlhylornithine (DMFO); retinoids such as retinoic acid; capecitabine; combretastatin; leucovorin (LV); oxaliplatin, including the oxaliplatin treatment regimen (FOLFOX); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

Further nonlimiting exemplary chemotherapeutic agents that can be administered in methods herein include anti-hormonal agents that act to regulate or inhibit hormone action on cancers such as anti-estrogens and selective estrogen receptor modulators (SERMs), including, for example, tamoxifen (including Nolvadex® tamoxifen), raloxifene, droloxifene, 4-hydroxytamoxifen, trioxifene, keoxifene, LY117018, onapristone, and Fareston toremifene; aromatase inhibitors that inhibit the enzyme aromatase, which regulates estrogen production in the adrenal glands, such as, for example, 4(5)-imidazoles, aminoglutethimide, Megase® megestrol acetate, Aromasin® exemestane, formestanie, fadrozole, Rivisor® vorozole, Femara® letrozole, and Arimidex® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Ralf and H-Ras; ribozymes such as a VEGF expression inhibitor (e.g., Angiozyme® ribozyme) and a HER2 expression inhibitor; vaccines such as gene therapy vaccines, for example, Allovectin® vaccine, Leuvectin® vaccine, and Vaxid® vaccine; Proleukin® rIL-2; Lurtotecan® topoisomerase 1 inhibitor; Abarelix® rmRH; and pharmaceutically acceptable salts, acids or derivatives of any of the above.

An "anti-angiogenesis agent" or "angiogenesis inhibitor" refers to a small molecular weight substance, a polynucleotide (including, e.g., an inhibitory RNA (RNAi or siRNA)), a polypeptide, an isolated protein, a recombinant protein, an antibody, or conjugates or fusion proteins thereof, that inhibits angiogenesis, vasculogenesis, or undesirable vascular permeability, either directly or indirectly. It should be understood that the anti-angiogenesis agent includes those agents that bind and block the angiogenic activity of the angiogenic factor or its receptor. For example, an anti-angiogenesis agent that can be administered in methods herein can include an antibody or other antagonist to an angiogenic agent, e.g., antibodies to VEGF-A (e.g., bevacizumab (Avastin®)) or to the VEGF-A receptor (e.g., KDR receptor or Flt-1 receptor), anti-PDGFR inhibitors such as Gleevec® (Imatinib Mesylate), small molecules that block VEGF receptor signaling (e.g., PTK787/ZK2284, SU6668, Sutent®/SU11248 (sunitinib malate), AMG706, or those described in, e.g., international patent application WO 2004/113304). Anti-angiogensis agents also include native angiogenesis inhibitors, e.g., angiostatin, endostatin, etc. See, e.g., Klagsbrun and D'Amore (1991) *Annu. Rev. Physiol.* 53:217-39; Streit and Detmar (2003) *Oncogene* 22:3172-3179 (e.g., Table 3 listing anti-angiogenic therapy in malignant melanoma); Ferrara & Alitalo (1999) *Nature Medicine* 5(12): 1359-1364; Tonini et al. (2003) *Oncogene* 22:6549-6556 (e.g., Table 2 listing known anti-angiogenic factors); and, Sato (2003) *Int. J. Clin. Oncol.* 8:200-206 (e.g., Table 1 listing anti-angiogenic agents used in clinical trials).

A "growth inhibitory agent" as used herein refers to a compound or composition that inhibits growth of a cell (such as a cell expressing VEGF) either in vitro or in vivo. Thus, the growth inhibitory agent that can be administered in methods herein may be one that significantly reduces the percentage of cells (such as a cell expressing VEGF) in S phase. Examples of growth inhibitory agents include, but are not limited to, agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in Mendelsohn and Israel, eds., *The Molecular Basis of Cancer*, Chapter 1, entitled "Cell cycle regulation, oncogenes, and antineoplastic drugs" by Murakami et al. (W.B. Saunders, Philadelphia, 1995), e.g., p. 13. The taxanes (paclitaxel and docetaxel) are anticancer drugs both derived from the yew tree. Docetaxel (Taxotere®, Rhone-Poulenc Rorer), derived from the European yew, is a semisynthetic analogue of paclitaxel (Taxol®, Bristol-Myers Squibb). Paclitaxel and docetaxel promote the assembly of microtubules from tubulin dimers and stabilize microtubules by preventing depolymerization, which results in the inhibition of mitosis in cells.

The term "anti-neoplastic composition" refers to a composition useful in treating cancer comprising at least one active therapeutic agent. Examples of therapeutic agents include, but are not limited to, e.g., chemotherapeutic agents, growth inhibitory agents, cytotoxic agents, agents used in radiation therapy, anti-angiogenesis agents, cancer immunotherapeutic agents, apoptotic agents, anti-tubulin agents, and other-agents to treat cancer, such as anti-HER-2 antibodies, anti-CD20 antibodies, an epidermal growth factor receptor (EGFR) antagonist (e.g., a tyrosine kinase inhibitor), HER1/EGFR inhibitor (e.g., erlotinib (Tarceva®), platelet derived growth factor inhibitors (e.g., Gleevec® (Imatinib Mesylate)), a COX-2 inhibitor (e.g., celecoxib), interferons, CTLA4 inhibitors (e.g., anti-CTLA antibody ipilimumab (YERVOY®)), PD-1 ore PD-L1 inhibitors (e.g., OPDIVO®, KEYTRUDA®, TECENTRIQ®, BAVENCIO®, IMFINZI®), TIM3 inhibitors (e.g., anti-TIM3 antibodies), cytokines, antagonists (e.g., neutralizing antibodies) that bind to one or more of the following targets ErbB2, ErbB3, ErbB4, PDGFR-beta, BlyS, APRIL, BCMA, CTLA4, TIM3, or VEGF receptor(s), TRAIL/Apo2, and other bioactive and organic chemical agents, etc. Combinations thereof are also included in this disclosure.

Antibodies Specifically Binding to VISTA-ECD at Acidic pH

Because VISTA has a large number of histidine residues in its extracellular domain (ECD), its folding and overall structure, as well as the surface available for the binding of ligands such as antibodies, may differ at acidic pH compared to neutral pH, in particular, near pH 6.5, which is the pKa for histidine. Since tumor microenvironments are generally acidic, for binding to VISTA in those microenvironments, an antibody may need to bind with specificity to VISTA at acidic pH where at least some of the surface histidine residues are more likely to be protonated.

The Sequence Table below provides the amino acid sequence of human VISTA (hVISTA) with or without signal peptide (SEQ ID NO: 1 and SEQ ID NO: 2 (mature hVISTA)), respectively. The signal peptide constitutes amino acid residues 1-32 of SEQ ID NO: 1. The extracellular domain (ECD) consists of amino acid residues 1-162 of SEQ ID NO: 2). The IgV domain constitutes amino acids residues 37-167 of SEQ ID NO: 1 and amino acid residues 5-135 of SEQ ID NO: 2. The stalk region is at amino acid residues 172-194 of SEQ ID NO: 1 and amino acid residues 136-162 of SEQ ID NO: 2; the transmembrane domain is at amino acid residues 195-216 of SEQ ID NO: 1 and amino acid residues 163-184 of SEQ ID NO: 2. Amino acid residue 187 of SEQ ID NO: 1 and 155 of SEQ ID NO: 2 (bold and underlined) can be either D or E, which represents a polymorphism in hVISTA. That residue is shown in bold, underlining. Accordingly, SEQ ID NO:1 and SEQ ID NO:2 encompass both of the human polymorphisms at that residue. The histidine residues in the ECD of VISTA are grey-shaded.

Anti-VISTA antibodies (Abs) may specifically bind to the VISTA-ECD or fragments thereof, e.g., comprising the IgV domain of VISTA or a region from hVISTA comprising, e.g., amino acids 20-95, 20-70 35-70, 35-95, 35-127 or 37-125 of SEQ ID NO: 2 at acidic pH. In certain embodiments, an Ab specifically binds to the VISTA-ECD protein at a pH that is less than pH 7.0. In certain embodiments, an Ab specifically binds to the VISTA-ECD protein at a pH that is less than pH 6.8. In certain embodiments, an Ab specifically binds to the VISTA-ECD protein at a pH that is less than pH 6.5. In certain embodiments, an Ab specifically binds to the VISTA-ECD protein at a pH that is less than pH 6.3. In certain embodiments, an Ab specifically binds to the VISTA-ECD protein at a pH that is less than pH 6.0. In certain embodiments, an Ab specifically binds to the VISTA-ECD protein at a pH that is less than pH 5.8. In certain embodiments, an Ab specifically binds to the VISTA-ECD protein at a pH that is less than pH 5.5. In certain embodiments, an Ab specifically binds to the VISTA-ECD protein at a pH that is less than pH 5.3. In certain embodiments, an Ab specifically binds to the VISTA-ECD protein at a pH that is less than pH 5.0.

Certain Abs specifically bind to a VISTA-ECD protein at a pH within a range of pH 5.0-pH 7.0. Certain Abs specifically bind to the VISTA-ECD protein at a pH within a range of pH 5.0-pH 6.5. Certain Abs specifically bind to the VISTA-ECD protein at a pH within a range of pH 5.0-pH 6.0. Certain Abs specifically bind to the VISTA-ECD protein at a pH within a range of pH 5.5-pH 7.0. Certain Abs specifically bind to the VISTA-ECD protein at a pH within a range of pH 5.5-pH 6.5. Certain Abs specifically bind to the VISTA-ECD protein at a pH within a range of pH 6.0-6.5.

Provided herein are also Abs that bind to a VISTA-ECD protein, such as hVISTA-ECD or fragments thereof comprising the IgV domain of VISTA or a region from hVISTA comprising, e.g., amino acids 20-95, 20-70 35-70, 35-95, 35-127 or 37-125 of SEQ ID NO:2 at a pH of 6.5 or less, with a $K_D$ of $10^{-6}$ M or less. In some embodiments, the Abs bind with a $K_D$ of $10^{-7}$ M or less. In some embodiments, the Abs bind with a $K_D$ of $10^{-8}$ M or less. In some embodiments, the Abs bind with a $K_D$ of $10^{-9}$ M. In some embodiments, the Abs bind with a $K_D$ of $10^{-10}$ M or less. For example, an Ab may bind to the VISTA-ECD protein at a pH of 6.5 or less with a $K_D$ of $10^{-8}$ M or less.

Provided herein are also Abs that bind to the VISTA-ECD protein within a pH range of 6.0-6.5 with a $K_D$ of $10^{-6}$ M or less. In some embodiments, the Abs bind with a $K_D$ of $10^{-7}$ M or less. In some embodiments, the Abs bind with a $K_D$ of $10^{-8}$ M or less. In some embodiments, the Abs bind with a $K_D$ of $10^{-9}$ M. In some embodiments, the Abs bind with a $K_D$ of $10^{-10}$ M or less. For example, an Ab may bind to the VISTA-ECD protein at a pH of 6.5 or less, e.g., within a pH range of 6.0-6.5, with a $K_D$ of $10^{-7}$ M or less. Further, an Ab may bind to the VISTA-ECD protein at a pH of 6.5 or less, e.g., within a pH range of 6.0-6.5, with a $K_D$ of $10^{-8}$ M or less. An Ab may bind to hVISTA-ECD at a pH of 6.5 or less, e.g., within a pH range of 6.0-6.5, with a $K_D$ of $10^{-9}$ M or less.

Provided herein are also Abs that specifically bind to a VISTA-ECD protein, such as hVISTA-ECD or fragments thereof comprising the IgV domain of VISTA or a region from hVISTA comprising, e.g., amino acids 20-95, 20-70 35-70, 35-95, 35-127 or 37-125 of SEQ ID NO: 2, e.g., at a pH of 6.5 or less, with a $k_{off}$ of $10^{-5}$ $s^{-1}$ or less at either 25° C. or at 37° C. In some embodiments, the Abs have a $k_{off}$ of $10^{-4}$ $s^{-1}$ or less at either 25° C. or at 37° C. In some embodiments, the Abs have a $k_{off}$ of 2 $10^{-4}$ $s^{-1}$ or less at either 25° C. or at 37° C. In some embodiments, the Abs have a $k_{off}$ of 5 $10^{-4}$ $s^{-1}$ or less at either 25° C. or at 37° C. In some embodiments, the Abs have a $k_{off}$ of 7 $10^{-4}$ $s^{-1}$ or less at either 25° C. or at 37° C. In some embodiments, the Abs have a $k_{off}$ of $10^{-3}$ $s^{-1}$ or less at either 25° C. or at 37° C. In some embodiments, the Abs have a $k_{off}$ of 2 $10^{-3}$ $s^{-1}$ or less at either 25° C. or at 37° C. In some embodiments, the Abs have a $k_{off}$ of 5 $10^{-3}$ $s^{-1}$ or less at either 25° C. or at 37° C. In some embodiments, the Abs have a $k_{off}$ of 7 $10^{-3}$ $s^{-1}$ or less at either 25° C. or at 37° C. In some embodiments, the Abs have a $k_{off}$ of $10^{-2}$ $s^{-1}$ at either 25° C. or at 37° C. In some embodiments, the Abs have a $k_{off}$ of $10^{-1}$ $s^{-1}$ or less at either 25° C. or at 37° C. For example, an Ab may specifically bind to the VISTA-ECD protein at a pH of 6.5 or less with a $k_{off}$ of $10^{-3}$ $s^{-1}$ or less at either 25° C. or at 37° C. An Ab may specifically bind to hVISTA-ECD at a pH of 6.5 or less with a $k_{off}$ of $10^{-3}$ $s^{-1}$ or less at either 25° C. or at 37° C. Further, an Ab may specifically bind to the VISTA-ECD protein at a pH of 6.5 or less with a $k_{off}$ of $10^{-2}$ $s^{-1}$ or less at either 25° C. or at 37° C.

Provided herein are Abs that bind to a VISTA-ECD protein, such as hVISTA-ECD or fragments thereof comprising the IgV domain of VISTA or a region from hVISTA comprising, e.g., amino acids 20-95, 20-70 35-70, or 35-95, 35-95, 35-127 or 37-125 of SEQ ID NO: 2, e.g., at a pH of 6.5 or less, with (i) a $K_D$ of 106 M or less, $10^{-7}$ M or less, $10^{-8}$ M or less, $10^{-9}$ M or less or $10^{-10}$ M or less and (ii) a $k_{off}$ rate of $10^{-5}$ $s^{-1}$ or less, $10^{-4}$ (or 2, 5 or 7 $10^{-4}$) $s^{-1}$ or less, $10^{-3}$ (or 2, 5 or 7 $10^{-4}$) $s^{-1}$ or less, $10^{-2}$ $s^{-1}$ or less, or $10^{-1}$ $s^{-1}$ or less, as measured, e.g., at 25° C. or at 37° C. For example, an Ab may bind to the VISTA-ECD protein at a pH of 6.5 or less with a $K_D$ of $10^{-7}$M or less and a $k_{off}$ rate of $10^{-3}$ $s^{-1}$ or less, as measured, e.g., at 25° C. or at 37° C. An Ab may bind to the VISTA-ECD protein at a pH of 6.5 or less with a $K_D$ of $10^{-8}$ M or less and a $k_{off}$ rate of $10^{-3}$ $s^{-1}$ or less, as measured, e.g., at 25° C. or at 37° C. An Ab may bind to the VISTA-ECD protein at a pH of 6.5 or less with a $K_D$ of $10^{-8}$ M or less and a $k_{off}$ rate of $10^{-2}$ $s^{-1}$ or less, as measured, e.g., at 25° C. or at 37° C. For example, an Ab may bind to h VISTA-ECD at a pH of 6.5 or less with a $K_D$ of $10^{-7}$M or less and a $k_{off}$ rate of $10^{-3}$ $s^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-3}$ $s^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-2}$ $s^{-1}$ or less, as measured, e.g., at 25° C. or at 37° C. An Ab may bind to hVISTA-ECD at a pH of 6.5 or less with a $K_D$ of $10^{-8}$ M or less and a $k_{off}$ rate of $10^{-4}$ (or 2, 5 or 7 $10^{-4}$) $s^{-1}$ or less, as measured, e.g., at 25° C. or at 37° C. An Ab may bind to h VISTA-ECD at a pH of 6.5 or less with a $K_D$ of $10^{-8}$ M or less and a $k_{off}$ rate of $10^{-5}$ (or 2, 5 or 7 $10^{-5}$) $s^{-1}$ or less, as measured, e.g., at 25° C. or at 37° C. An Ab may bind to hVISTA-ECD at a pH of 6.5 or less with a $K_D$ of $10^{-9}$M or less and a $k_{off}$ rate of $10^{-4}$ (or 2, 5 or 7 $10^{-4}$) $s^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-5}$ (or 2, 5 or 7 $10^{-5}$) $s^{-1}$ or less, as measured, e.g., at 25° C. or at 37° C.

Provided herein are Abs that specifically bind to the VISTA-ECD protein, e.g., at a pH of 6.5 or less, with a $k_{on}$ of $10^4$ $M^{-1}$ $s^{-1}$ or higher at 25° C. or at 37° C. In some such embodiments, the Abs may bind with a $k_{on}$ of $10^5$ $M^{-1}$ $s^{-1}$ or higher. In some such embodiments, the Abs may bind with a $k_{on}$ of $10^6$ $M^{-1}$ $s^{-1}$ or higher. In some such embodiments, the Abs may bind with a $k_{on}$ of $10^7$ $M^{-1}$ $s^{-1}$ or higher. For example, an Ab may bind to the VISTA-ECD protein at a pH of 6.5 or less with a $k_{on}$ of $10^6$ $M^{-1}$ $s^{-1}$ or higher, as measured, e.g., at 25° C. or at 37° C. For example, an Ab may bind to the ECD of hVISTA at a pH of 6.5 or less with a $k_{on}$ of $10^6$ $M^{-1}$ $s^{-1}$ or higher, as measured, e.g., at 25° C. or at 37° C.

Provided herein are Abs that bind to the VISTA-ECD protein, e.g., at a pH of 6.5 or less, with (i) a $K_D$ of $10^{-6}$ M or less, $10^{-7}$ M or less, $10^{-8}$ M or less, $10^{-9}$ M or less or $10^{-10}$ M or less and (ii) a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. For example, an Ab may bind to the VISTA-ECD protein at a pH of 6.5 or less with a $K_D$ of $10^{-7}$M or less and a $k_{on}$ rate of $10^6$ $M^{-1}$ $s^{-1}$ or higher, as measured, e.g., at 25° C. or at 37° C. For example, an Ab may bind to the VISTA-ECD protein at a pH of 6.5 or less with a $K_D$ of $10^{-8}$ M or less and a $k_{on}$ rate of $10^6$ $M^{-1}$ $s^{-1}$ or higher, as measured, e.g., at 25° C. or at 37° C. For example, an Ab may bind to hVISTA-ECD at a pH of 6.5 or less with a $K_D$ of $10^{-7}$M or less and a $k_{on}$ rate of $10^6$ $M^{-1}$ $s^{-1}$ or higher, as measured, e.g., at 25° C. or at 37° C. For example, an Ab may bind to hVISTA-ECD at a pH of 6.5 or less with a $K_D$ of $10^{-8}$ M or less and a $k_{on}$ rate of $10^6$ $M^{-1}$ $s^{-1}$ or higher, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{off}$ of $10^{-5}$ $s^{-1}$ or less, 2 $10^{-5}$ $s^{-1}$ or less, 5 $10^{-5}$ $s^{-1}$ or less, 7 $10^{-5}$ $s^{-1}$ or less, $10^{-4}$ $s^{-1}$ or less, 2 $10^{-4}$ $s^{-1}$ or less, 5 $10^{-4}$ $s^{-1}$ or less, 7 $10^{-4}$ $s^{-1}$ or less, $10^{-3}$ $s^{-1}$ or less, 2 $10^{-3}$ $s^{-1}$ or less, 5 $10^{-3}$ $s^{-1}$ or less, 7 $10^{-3}$ $s^{-1}$ or less, $10^{-2}$ $s^{-1}$ or less, or $10^{-1}$ $s^{-1}$ or less, as measured, e.g., at 25° C. or at 37° C. In some embodiments, an Ab may bind to the VISTA-ECD protein at a pH of 6.5 or less with a $K_D$ of $10^{-9}$M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C. In some such embodiments, an Ab may bind to the VISTA-ECD protein at a pH of 6.5 or less with a $K_D$ of $10^{-10}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-8}$ M or less as well as with a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-9}$ M or less as well as with a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some such embodiments, an Ab may bind to the VISTA-ECD protein at a pH of 6.5 or less with a $K_D$ of $10^{-10}$ M or less as well as with a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-8}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-9}$M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some such embodiments, an Ab may bind to the VISTA-ECD protein at a pH of 6.5 or less with a $K_D$ of $10^{-10}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C.

As noted also above, in some of the above embodiments, the VISTA-ECD protein is hVISTA-ECD or is a portion of hVISTA-ECD such as, for example, the IgV domain. In some of the above embodiments, the Ab may bind specifically to an epitope comprising amino acids 20-95 of SEQ ID NO:2. In some of the above embodiments, the Ab may bind specifically to an epitope comprising amino acids 20-70 of SEQ ID NO:2. In some of the above embodiments, the Ab may bind specifically to an epitope comprising amino acids 35-95 of SEQ ID NO:2. In some of the above embodiments, the Ab may bind specifically to an epitope comprising amino acids 35-70 of SEQ ID NO:2. In some embodiments above, the epitope is a three-dimensional epitope that comprises not only one of the above portions of SEQ ID NO:2 from residues 20-95, 20-70, 35-95, or 35-70, but also another portion of SEQ ID NO: 2, such as residues 95-105 of SEQ ID NO:2. In certain embodiments, an Ab binds to the epitope of hVISTA to which an Ab described in WO2015/097536 binds. For example, an Ab may compete or cross-compete for binding to hVISTA with an Ab disclosed in WO2015/097536. In certain embodiments, an Ab binds to a conformational epitope of human VISTA. In certain embodiments, an Ab binds to a conformational epitope that comprises, or is present within, residues 103-111 of SEQ ID NO: 2 and 136-146 of SEQ ID NO: 2 for human VISTA. In certain embodiments, an Ab binds to a conformational epitope that comprises, or is present within, residues 24-36, 54-65, and 100-102 of SEQ ID NO:2 for human VISTA. In certain embodiments, an Ab binds to a conformational epitope that comprises amino acid residues in the FG loop of human VISTA. In some embodiments, an Ab binds to a polypeptide comprising amino acid residues 35 to 127 and/or 37-125 of SEQ ID NO: 2. In some embodiments, an Ab binds to a VISTA ECD polypeptide or portion thereof comprising amino acid residues 350-127 of SEQ ID NO: 2, but the antibody does not bind or binds with reduced affinity to the VISTA ECD polyptide or portion thereof comprising an amino acid substitution, wherein the substitution (1) is substitution of one of the following amino acid residues: T35, Y37, K38, T39, Y41, R54, T61, F62, Q63, L65, H66, L67, H68, H69, F97, L115, V117, I119, H121, H122, S124, E125, R127 and SEQ ID NO: 2 or (2) is a substitution of one of the following amino acid residues: Y37, T39, R54, F62, Q63, H66, L115, V117, I119, S124, or E125. In some embodiments, an anti-VISTA antibody has the same binding characteristics (or significantly the same binding characteristics) as an antibody described herein, e.g., as set forth in the Examples and/or in the claims.

Some of the above antibodies may show differential binding affinity for VISTA-ECD proteins depending upon pH. Certain Abs specifically binding to a VISTA-ECD protein in acidic conditions, e.g., at pH 6.5 or less, also specifically bind the VISTA-ECD protein at neutral and/or alkaline pH with similar affinity (i.e. they are "pan binders"). For example, some such Abs may bind to the VISTA-ECD protein with a $K_D$ of $10^{-7}$M or less at both pH 6.5 and at pH 7.0 (at a constant temperature, e.g., of 25° C. or at 37° C.) such that the $K_D$ at pH 6.5 is within 1.5-fold of the $K_D$ at pH 7.0. Some such Abs may bind to the VISTA-ECD protein with a $K_D$ of $10^{-8}$M or less at both pH 6.5 and at pH 7.0 (at a constant temperature, e.g., of 25° C. or at 37° C.) such that the $K_D$ at pH 6.5 is within 1.5-fold of the $K_D$ at pH 7.0. Some such Abs may bind to hVISTA-ECD with a $K_D$ of $10^{-8}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0.

Certain Abs specifically binding to a VISTA-ECD protein in acidic conditions, e.g., at pH 6.5 or less, may bind the VISTA-ECD protein at neutral, physiological, and/or alkaline conditions with lower affinity ("pH sensitive binders" or "pH sensitive Abs"). Certain Abs specifically binding to a VISTA-ECD protein in acidic conditions, e.g., at pH 6.5 or less, may have non significant, e.g., nearly undetectable, binding to the VISTA-ECD protein in neutral, physiological and/or alkaline conditions. For example, in some embodiments, Abs may bind to the VISTA-ECD protein with a $K_D$ of $10^{-8}$ M or less at pH 6.5 and with a $K_D$ of more than $10^{-8}$ M at pH 7.0 and/or pH 7.4. In some such embodiments, Abs may bind to the VISTA-ECD protein with a $K_D$ of $10^{-8}$ M or less at pH 6.5 and with a $K_D$ at pH 7.0 and/or pH 7.4 that is more than 1.5-fold higher than that at pH 6.5. In certain embodiments, a pH sensitive Ab is provided that specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 (at a constant temperature, e.g., of 25° C. or at 37° C.). For example, in some cases an Ab binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 and/or pH 7.4 or higher (at a constant temperature, e.g., of 25° C. or at 37° C.).

In certain embodiments, an Ab specifically binds to a VISTA-ECD protein with a $k_{off}$ that is lower in acidic conditions relative to that in neutral, physiological, or alkaline conditions. In certain embodiments, an Ab is provided that binds to the VISTA-ECD protein in acidic conditions with a $k_{off}$ that is at least 1.5 fold, 2 fold, 5 fold, 10 fold, 20 fold, 50 fold, 100 fold, or 1000 fold lower at pH 6.5 than the $k_{off}$ at pH 7.0 and/or pH 7.4, as measured, e.g., at 25° C. or at 37° C. In other words, the off-rate is slower at acidic pH than at neutral pH. For example, in some embodiments, an Ab specifically binds to a VISTA-ECD protein with a $k_{off}$ rate that is at least 1.5 fold, 2 fold, 5 fold, 10 fold, 20 fold, 50 fold, 100 fold or 1000 fold lower at pH 6.0, relative to pH 7.0 and/or pH 7.4, as measured, e.g., at 25° C. or at 37° C. In certain embodiments, an Ab is provided that binds to the VISTA-ECD protein with a $k_{off}$ that is at least 1.5 fold, 2 fold, 5 fold, 10 fold, 20 fold, 50 fold, 100 fold or 1000 fold lower at pH 6.5 than the $K_{off}$ at pH 7.4, as measured, e.g., at 25° C. or at 37° C. In some embodiments, an Ab specifically binds to a VISTA-ECD protein with a $k_{off}$ rate that is at least 1.5 fold, 2 fold, 5 fold, 10 fold, 20 fold, 50 fold, 100 fold or 1000 fold lower at pH 6.0, relative to pH 7.4, as measured, e.g., at 25° C. or at 37° C. In certain embodiments, an Ab is provided that binds to the VISTA-ECD protein with a $k_{off}$ that is at least 1.5 fold, 2 fold, 5 fold, 10 fold, 20 fold, 50 fold, 100 fold or 1000 fold lower at pH 6.0-6.5 than the $k_{off}$ at pH 7.0-7.4, as measured, e.g., at 25° C. or at 37° C.

In certain embodiments, an Ab that specifically binds to a VISTA-ECD protein with a $k_{on}$ that is higher in acidic conditions relative to neutral, physiological, or alkaline conditions. In certain embodiments, an Ab is provided that binds to a VISTA-ECD protein in acidic conditions with a $k_{on}$ that is at least 2 fold, 5 fold, 10 fold, 20 fold, 50 fold, 100 fold, or 1000 fold higher at pH 6.5 than the $k_{on}$ at pH 7.0 and/or pH 7.4, as measured, e.g., at 25° C. or at 37° C. For example, in some embodiments, an Ab specifically binds to a VISTA-ECD protein with a $k_{on}$ that is at least 2 fold, 5 fold, 10 fold, 20 fold, 50 fold, 100 fold or 1000 fold higher at pH 6.0 than at pH 7.0 and/or pH 7.4, as measured, e.g., at 25° C. or at 37° C.

In certain embodiments, an Ab specifically binds to a VISTA-ECD protein at a pH at which at least one histidine residue, e.g., His 98 in SEQ ID NO: 1, is protonated. In certain embodiments, an Ab specifically binds to a VISTA-ECD protein at a pH at which most histidine residues in the ECD are protonated, which is expected to be pH 6.5 or less, e.g., between pH 6.0 and pH 6.5.

Also encompassed herein are Abs that specifically bind to a VISTA-ECD protein with an affinity that is higher at neutral, physiological, or alkaline pH relative to acidic pH, provided that the affinity of binding at acidic pH remains high. For example, Abs may bind to the VISTA-ECD protein with a $K_D$ of $10^{-8}$M or less at both pH 6.5 and pH 7.0 even though the Abs bind with a $K_D$ that is at least 1.5 fold, 2 fold, 5 fold, 10 fold, 20 fold, 50 fold, 100 fold, 300 fold, 500 fold, 1000 fold lower at pH 7.0 than at pH 6.5.

Also encompassed herein are Abs that share one or more of the above properties of this section. The above properties, such as particular $K_D$'s, $k_{off}$'s, $k_{on}$'s, specific epitopes are not to be treated in isolation. Thus, an Ab may bind to an epitope comprising one of the regions of SEQ ID NO:2 described above, and also may have pan binding or pH sensitive or pH selective binding properties as described above, as shown by one or more of the behaviors of its $K_D$, $k_{off}$, or $k_{on}$ at different pH's.

In any of the above embodiments, the Ab may be, for example, a full length antibody (i.e., comprising a full length heavy chain (with or without C-terminal lysine) and a full length light chain), or an antigen binding fragment such as a Fab fragment, a Fab' fragment, $(Fab')_2$ fragment, an scFv fragment, an Fv fragment, or the Ab may be a chimeric, humanized, or human antibody, or the Ab may be a bispecific or multispecific antibody. Determining how well an Ab binds to a VISTA-ECD protein at a given pH can be conducted using several different methods. For example, by surface plasmon resonance (SPR), such as by BIACORE® assays. An exemplary SPR assay comprises capturing one or several antibodies on a CM4 sensor chip with immobilized capture reagent (e.g., using Biacore® anti-human Fc capture kit, GE Healthcare catalog #BR-1008-39, or Biacore® anti-mouse capture kit, GE Healthcare catalog #BR-1008-39), and flowing VISTA antigen as analyte in a concentration series to determine binding kinetics and affinities in a running buffer with desired pH. In one embodiment, VISTA is injected at two to five concentrations in the range of 0.1 nM to 500 nM (e.g., 0.1 nM, 1 nM, 10 nM, 100 nM, 500 nM) with a flow rate of 30 μL/min, up to four minutes association time and up to ten minutes dissociation time. Between binding cycles, the capture surface is regenerated following the manufacturer's instructions for the respective capture kit. All data is double-referenced using a reference flow cell and a blank injection. Data with simple 1:1 kinetics are fitted to a Langmuir binding model with mass transfer using the Biacore® T200 evaluation software. The SPR methods described in the Examples may also be used.

The affinity of an Ab for a VISTA ECD polypeptide may be determined using cells expressing a VISTA ECD polypeptide, PSGL-1 or heparan sulfate on their surface, which method comprises flow cytometry, and wherein binding of an Ab to cell bound VISTA-ECD is determined at a given pH, e.g., pH 6.5 or less. An exemplary flow cytometry assay comprises the following: 293T cells or other cells ectopically expressing h VISTA ECD are re-suspended in a buffer consisting of HBSS+1% BSA adjusted to the desirable pH, e.g., pH 6.0 with MES or pH 7.4 with HEPES. Abs (e.g., human IgG) against hVISTA are serially diluted from approximately 20 μg/mL and incubated with the re-suspended cells for 30 minutes at 4° C. Cells are then washed twice with the same buffers, maintaining the desired pH, e.g., pH at 6.0 or 7.4, and incubated with a fluorophore-conjugated secondary antibody that recognizes the primary antibody (e.g., human IgG) and is stable at reduced pH. Cells are then washed as before and acquired immediately, without fixation, on a BD Fortessa or other flow cytometer. The affinity of an Ab for a VISTA ECD polypeptide may be determined as described in the Examples.

In certain embodiments, Abs that bind to hVISTA ECD block binding of h VISTA to its binding partner (e.g., a VISTA receptor), e.g., on cells. Inhibition or blocking may be 100% or at least 99%, 95%, 90%, 85%, 80%, 75%, or 50%. In certain embodiments, an Ab binds to a VISTA-ECD protein at acidic pH, e.g., pH 6.5 or less, and inhibits binding of VISTA to its binding partner by at least 50%, such as by at least 75%, 80%, 85%, 90%, 95%, or 100%. In certain embodiments, an Ab specifically binds to the VISTA-ECD protein and inhibits binding of VISTA to its binding partner by at least 50% at a pH that is less than pH 7.0. In certain embodiments, an Ab specifically binds to a VISTA-ECD protein and inhibits binding of VISTA to its binding partner by at least 50% at a pH that is less than pH 6.8. In certain embodiments, an Ab specifically binds to a VISTA-ECD protein and inhibits binding of VISTA to its binding partner by at least 50% at a pH that is less than pH 6.5. In certain embodiments, an Ab specifically binds to a VISTA-ECD protein and inhibits binding of VISTA to its binding partner by at least 50% at a pH that is less than pH 6.3. In certain embodiments, an Ab specifically binds to a VISTA-ECD protein and inhibits binding of VISTA to its binding partner by at least 50% at a pH that is less than pH 6.0. In certain embodiments, an Ab specifically binds to a VISTA-ECD protein and inhibits binding of VISTA to its binding partner by at least 50% at a pH that is less than pH 5.8. In certain embodiments, an Ab specifically binds to a VISTA-ECD protein and inhibits binding of VISTA to its binding partner by at least 50% at a pH that is less than pH 5.5. In certain embodiments, an Ab specifically binds to a VISTA-ECD protein and inhibits binding of VISTA to its binding partner by at least 50% at a pH that is less than pH 5.3. In certain embodiments, an Ab specifically binds to a VISTA-ECD protein and inhibits binding of VISTA to its binding partner by at least 50% at a pH that is less than pH 5.0.

Certain Abs specifically bind to a VISTA-ECD protein and inhibits binding of VISTA to its binding partner by at least 50% at a pH within a range of pH 5.0-pH 7.0. Certain Abs specifically bind to a VISTA-ECD protein and inhibits binding of VISTA to its binding partner by at least 50% at a pH within a range of pH 5.0-pH 6.5. Certain Abs specifically bind to a VISTA-ECD protein and inhibits binding of VISTA to its binding partner by at least 50% at a pH within a range of pH 5.0-pH 6.0. Certain Abs specifically bind to a VISTA-ECD protein and inhibits binding of VISTA to its binding partner by at least 50% at a pH within a range of pH 5.5-pH 7.0. Certain Abs specifically bind to a VISTA-ECD protein and inhibits binding of VISTA to its binding partner by at least 50% at a pH within a range of pH 5.5-pH 6.5. Certain Abs specifically bind to a VISTA-ECD protein and inhibits binding of VISTA to its binding partner by at least 50% at a pH within a range of pH 6.0-6.5. Inhibition of binding can be determined as described in the Examples.

A VISTA binding partner may be PSGL-1, such as human PSGL-1. Sequences of human PSGL-1 isoforms are provided as SEQ ID NOs: 3-10 herein. VISTA binds to PSGL-1 with or without siayl lewis X. A binding partner may also be heparan sulfate proteoglycans, e.g., present on certain cells.

Inhibition of binding to a VISTA binding partner can be determined by measuring the inhibition of binding of VISTA (or VISTA ECD or VISTA IgV domain or VISTA positive cells), to cells to which VISTA binds, e.g., T cells (e.g., CD4+ T cells, CD8+ T cells, either activated or not), NK cells, or other cells to which VISTA binds, in the presence and absence of the antibody. An exemplary experiment that can be used to determine if an antibody inhibits the binding of VISTA to its binding partner or T cells expressing a binding partner is a flow cytometry assay, e.g., an assay that comprises the following: human peripheral blood mononuclear cells from donor blood, buffy coat, or leukopak are re-suspended in a buffer consisting of HBSS+1% BSA adjusted to the desirable pH, e.g., pH 6.0 with MES or pH 7.4 with HEPES. The cells are then incubated for 30 minutes at 4° C. with 20 g/mL recombinant chimeric protein consisting of hVISTA ECD fused to human IgG1 Fc (VISTA-Fc) and with varying concentrations of candidate VISTA blocking antibodies or control antibodies. Cells are then washed twice in the same buffers, maintaining the desired pH, e.g., pH at 6.0 or 7.4, and incubated for another 30 minutes at 4° C. with a fluorophore-conjugated secondary antibody that recognizes VISTA-Fc, but not the candidate blocking antibodies or control antibodies, and is stable at reduced pH. Cells are then washed as before and acquired immediately, without fixation, on a BD Fortessa or other flow cytometer. Inhibition of binding can be determined, e.g., as described in the Examples.

In specific embodiments, the Abs described herein may trigger or enhance an immune response, such as an antigen-specific immune response. In certain embodiments, the Abs stimulate T cell activity, particularly at acidic pH such as is found in tumor microenvironments. Stimulation of T cell activity can be measured, e.g., in a mixed lymphocyte reaction (MLR) or in an in vitro assay with an antigen presenting cell (natural or artificial) and T cells. Stimulation of T cell activity can also be measured using, e.g., the Jurkat assay described in the Examples. Stimulation of T cell activity may also be measured by determining IFN-γ secretion from T cells, wherein an enhanced IFN-γ secretion indicates T cell stimulation. Secretion of other cytokines from activated T cells may also be measured. In certain embodiments, signal transduction of activated T cells is measured, such as NF-kB levels. In specific embodiments, the Abs described herein inhibit cell adhesion, which can be measured as described in the Examples.

Activity of anti-VISTA Abs can also be shown in monocyte assays, ADCC assays, and ADCP assays, particularly at acidic pH such as is found in tumor microenvironments.

In certain embodiments, anti-VISTA Abs inhibit tumor growth in a tumor model, e.g., a human VISTA knock-in tumor model.

As shown in the Examples herein, recycling of an anti-VISTA Ab in the endosome such as to enhance the pharmacokinetic (PK) properties, i.e., half-life, of the antibody, requires the anti-VISTA antibody to bind to VISTA in acidic conditions. Thus, anti-VISTA Abs that bind at low pH to VISTA, e.g., a pH of 6.5 or lower, as further described herein, are also expected to have a longer acceptable half-life relative to a VISTA antibody that does not bind to VISTA at acidic pH.

In some embodiments, a VISTA antibody preferably binds in vivo to tumor(s) over myeloid cells. Particular anti-VISTA Ab herein have been shown in a VISTA knock-in mouse to localize preferentially to the tumor over the blood. For example, in some embodiments, antibodies herein accumulate at levels at least twice as high in tumors relative to the blood 24 to 51 hours after administration of the Ab to a subject. In some embodiments, an anti-VISTA Ab does not accumulate significantly more in the liver or lungs relative to the blood of the subject. In some embodiments, anti- VISTA Ab in the tumor may be sustained over time, e.g., up to at least 51 hours post administration of the VISTA Ab to the subject. In some embodiments, the localization of the anti-VISTA Ab in the subject is determined by administering to the subject the Ab labeled with a PET tracer.

Exemplary hVISTA-ECD Binding Abs

Provided herein are Abs that bind preferentially to hVISTA (ECD) at acidic pH (e.g., in acidic conditions) relative to physiological pH or neutral pH.

The present disclosure describes anti-h VISTA Abs including the following: P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, and P1-068748_D57K_D100S. These antibodies may contain the heavy chain CDRs of either P1-068744 or P1-068748 Abs modified to revert at least one H, D, or E residue back to the residue found at the same position in the P1-061015 parental antibody. The antibodies may, in some embodiments, comprise the light chain CDRs of antibody P1-061015.

Figure 29A:
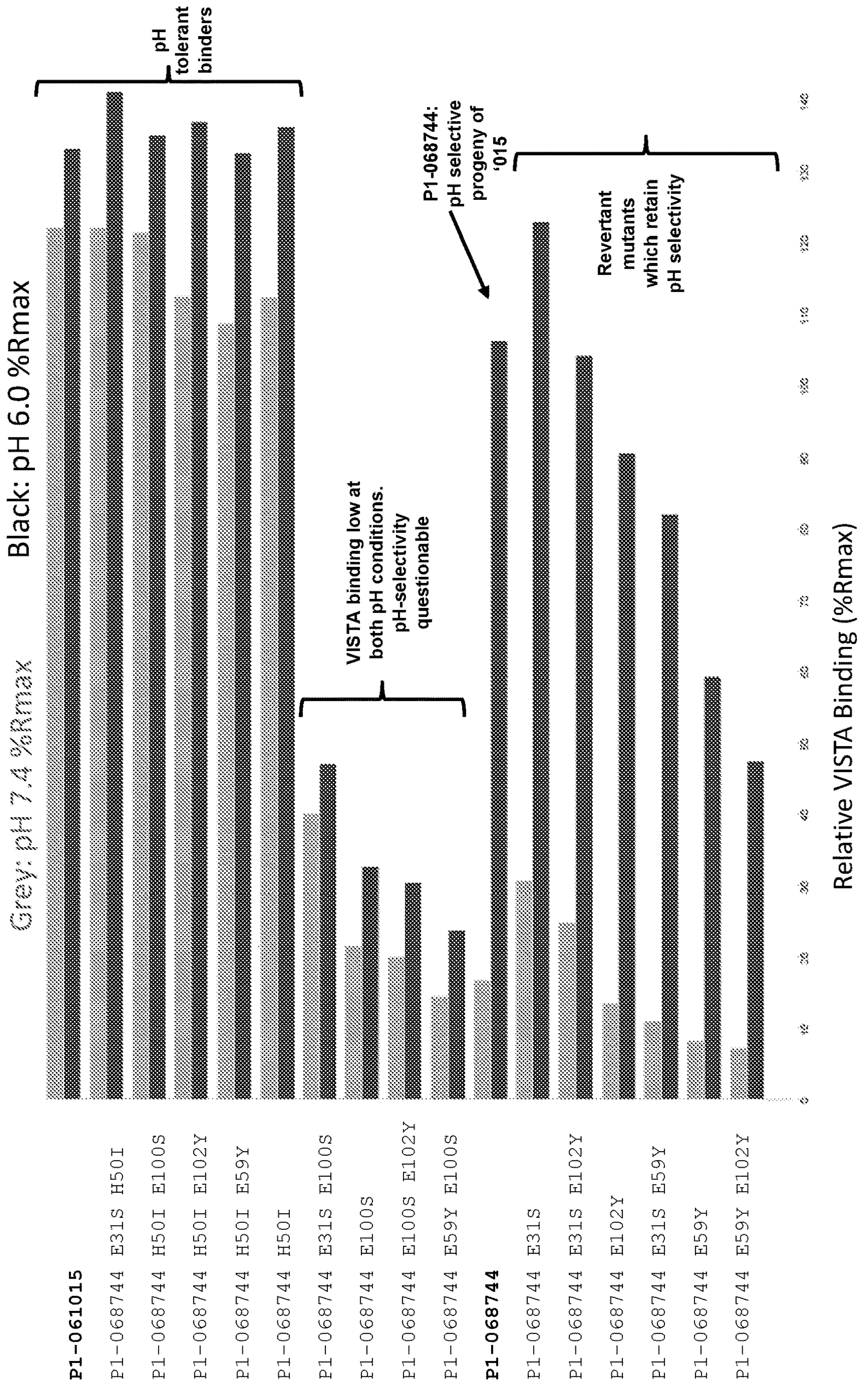

More generally, the present disclosure includes anti-hVISTA Abs comprising a heavy chain variable region (VH) comprising a VH CDR1 comprising GFTFS$X_1$YAMH, wherein $X_1$ is E or S (SEQ ID NO: 690); a VH CDR2 comprising $X_2$IWYDGSNKY$X_3$ADSVKG, wherein $X_2$ is H or I, and $X_3$ is E or Y (SEQ ID NO: 691); and/or a VH CDR3 comprising DSGFYX$_4$SYYFDX$_5$, wherein $X_4$ is E or S and $X_5$ is E or Y (SEQ ID NO: 692). In Ab P1-061015, these positions are S, I, Y, S, and Y, respectfully, while in P1-068744, these positions are E, H, E, E and E. (See FIG. 29C, for example.) In such cases, the antibody may comprise VH CDR1, CDR2 and/or CDR3 of P1-068744, but with the following, specified reversions back to the positions of P1-61015 (see Tables 11 and 27): P1-068744_E31S (i.e., comprising the CDRs of P1-068744 except that $X_1$ is S), P1-68744_H50I (i.e., $X_2$ is I), P1-68744_E59Y (i.e., $X_3$ is Y), P1-068744_E100S (i.e., $X_4$ is S), P1-068744_E102Y (i.e., $X_5$ is Y), P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, or P1-068744_E59Y_E102Y. Note that the nomenclature of these antibodies used above is based on the Kabat numbering scheme, which numbers residues in part by their structural positions rather than by their sequence positions. As antibodies may have CDRs of different lengths, that numbering scheme may not necessarily correspond to the residue position numbers of the antibody sequence. The above substitutions at $X_1$, $X_2$, $X_3$, $X_4$, and $X_5$ are located at positions 31, 50, 60, 104, and 110 of the heavy chain sequence of SEQ ID Nos: 95 and 103 herein, as can also be seen readily from reviewing Tables 11 and 27. See, e.g, M. Dondelinger et al., Front. Immunol. 9:2278 (2018), for further information regarding antibody residue numbering formats.

In some embodiments, the antibodies may comprise the heavy chain CDRs of P1-068744 or of one of the above mutants in which $X_2$ is H. In some embodiments, the antibodies may comprise the heavy chain CDRs of P1-068744 or of one of the above mutants in which $X_2$ is H and $X_4$ is E (i.e., that do not comprise an H50I or an E100S mutation). Examples include antibodies comprising the heavy chain CDRs of P1-068744, P1-068744_E31S, P1-068744_E31S_E102Y, P1-068744_E102Y, P1-068744_E31S_E59Y, P1-068744_E59Y, and P1-068744_E59Y_E102Y. In some embodiments, these antibodies further have (a) an affinity for hVISTA (e.g. by surface plasmon resonance (SPR)) represented by a Kd of $<5\times10^{-8}$ M, of $<1\times10^{-8}$ M, of $<5\times10^{-9}$M, or of $<3\times10^{-9}$M; (b) a Kd of $1\times10^{-8}$ and $1\times10^{-6}$ at pH 7.4 (e.g., measured by SPR); and/or (c) the antibodies further have a $k_{off}$ at pH 6.0 of $<5\times10^{-3}$ (1/s), $<4\times10^{-3}$ (1/s), or $<3\times10^{-3}$ (1/s) (e.g. as measured by SPR). In other embodiments, the antibodies retain an H at position $X_2$ and an E at position $X_3$. In some embodiments, the antibodies retain an E at both positions $X_3$ and $X_4$. And, in some embodiments, the antibodies retain an H at $X_2$, an E at $X_3$, and an E at $X_4$ compared to P1-068744. Examples include antibodies comprising the heavy chain CDRs of P1-068744, P1-068744_E31S, P1-068744_E31S_E102Y, and P1-068744_E102Y. In embodiments above, the antibodies may comprise the heavy chain CDRs of one of those antibodies and the light chain CDRs of the P061015 antibody. In some embodiments, anti-hVISTA antibodies are those described herein, e.g., above, with no other amino acid substitutions in the CDRs or the variable regions.

In addition, the present disclosure includes anti-hVISTA Abs comprising a heavy chain variable region (VH) comprising a VH CDR1 comprising GFTFS$X_1X_2$AMH, wherein $X_1$ is H or S, and $X_2$ is H or Y (SEQ ID NO: 693); a VH CDR2 comprising IIWYDGSN$X_3X_4$YADSVKG, wherein $X_3$ is D or K, and $X_4$ is D or Y (SEQ ID NO: 694); and/or a VH CDR3 comprising DSGFY$X_5$SYYFDY, wherein $X_5$ is D or S (SEQ ID NO: 695). In Ab P1-061015, these positions are S, Y, K, Y, and S, respectfully, while in P1-068748, these positions are H, H, D, D and D. (See FIG. 29C.) In such cases, the antibody may comprise VH CDR1, CDR2 and/or CDR3 of P1-068748, but with the following, specified reversions back to the positions of P1-61015 (see Tables 12 and 28): VH CDR1, CDR2 and/or CDR3 of P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. Note that the nomenclature herein is based on Kabat numbering. The above substitutions at $X_1$, $X_2$, $X_3$, $X_4$, and $X_5$ are located at positions 31, 32, 58, 59, and 104 of the heavy chain sequences of SEQ ID Nos: 95 and 99, as can also be seen from reviewing Tables 12 and 28 and SEQ ID Nos: 95 and 99, for example.

In some such embodiments, the heavy chain CDRs may retain a D at position $X_5$ (i.e., at amino acid sequence position 104; i.e., they do not contain a D100S substitution as described in the above nomenclature). In some cases the antibody retains a D at sequence position $X_5$ and also displays pH-selective binding to hVISTA. In some cases the antibody retains a D at position $X_4$. In some cases the antibody retains a D at both positions $X_4$ and $X_5$ (i.e., it does ot include either a D58Y or a D100S substitution relative to P1-068744). In some cases, the antibody comprises the heavy chain CDRs of P1-068748, P1-068748_H31S, P1-068748_H32Y, P1-068748_D57K, P1-068748_H31S_H32Y, P1-068748_H32Y_D57K, or P1-068748_H31S_D57K. In some such cases, the antibodies may comprise the heavy chain CDRs of one of those antibodies and the light chain CDRs of the P061015 antibody. In some embodiments, the antibodies further have (a) an affinity for hVISTA (e.g. by surface plasmon resonance (SPR)) represented by a Kd of $<1\times10^{-8}$ M, of $<7\times10^{-9}$M, or of $<5\times10^{-9}$ M; (b) a Kd of $5\times10^{-8}$ and $1\times10^{6}$ at pH 7.4 (e.g., measured by SPR); and/or (c) the antibodies further have a koff at pH 6.0 of $<5\times10^{-3}$ (1/s), $<4\times10^{-3}$ (1/s), or $<3\times10^{-3}$ (1/s) (e.g. as measured by SPR). In some embodiments, anti-hVISTA antibodies are those described herein, e.g., above, with no other amino acid substitutions in the CDRs or variable regions.

In certain embodiments, anti-hVISTA antibodies comprise the VH and VL CDRs of P1-068744 or P1-068748 or comprise the VH and VL of P1-068744 or P1-068748 comprising amino acid reversions to those in P1-061015, wherein these amino acid reversions do not affect the desired characteristics of the antibodies. For example, anti-hVISTA antibodies may comprise VH and VL, or VH and VL CDRs, of P1-068744 or P1-068748, which reversion mutations that do not affect the pH selectivity and/or binding kinetics, as further described herein.

In certain embodiments, an anti-hVISTA Ab comprises a heavy chain variable region ("VH") comprising VH CDR1, CDR2 and/or CDR3 of any of the anti-hVISTA Abs provided herein. In certain embodiments, an anti-hVISTA Ab comprises a VH comprising the VH CDR1, CDR2 and CDR3 of any of the anti-hVISTA Abs provided herein. In certain embodiments, an anti-hVISTA Ab comprises a VH comprising VH CDR1, CDR2 and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. The VH CDR1, CDR2, and CDR3 of each of these species comprise amino acid positions 26-35 (VH CDR1), 50-66 (VH CDR2), and 99-110 (VH CDR3), of the VH sequences for each of the above antibody species provided in the sequence table below. The CDRs are also underlined and in bold on each of the VH sequences for the above antibody species provided in the Sequence Table below.

In certain embodiments, an anti-hVISTA Ab comprises a VL comprising VL CDR1, CDR2 and CDR3 of any of the anti-hVISTA Abs provided herein. In certain embodiments, an anti-hVISTA Ab comprises a VL comprising VL CDR1, CDR2 and CDR3 of one of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. The VL CDR1, CDR2, and CDR3 of each of these species comprise amino acid positions 24-35 (VL CDR1), 51-57 (VL CDR2), and 90-98 (VL CDR3), of the VL sequences for each of the above antibody species provided in the Sequence Table below. The CDRs are also underlined and in bold on each of those sequences.

In certain embodiments, an anti-hVISTA Ab comprises a VH comprising VH CDR1, CDR2 and/or CDR3 of any of the anti-hVISTA Abs provided herein and a VL comprising CDR1, CDR2 and/or CDR3 of any of the anti-hVISTA Abs provided herein. In certain embodiments, an anti-hVISTA Ab comprises a VH comprising VH CDR1, CDR2 and CDR3 of any of the anti-h VISTA Abs provided herein and a VL comprising CDR1, CDR2 and CDR3 of any of the anti-hVISTA Abs provided herein. In certain embodiments, an anti-hVISTA Ab comprises a VH comprising VH CDR1, CDR2 and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE and a VL comprising VL CDR1, CDR2 and CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

In some embodiments, an anti-hVISTA Ab may comprise:

(a) a VH comprising the amino acid sequence of the VH CDR1, CDR2 and CDR3 of P1-061029 and a VL comprising the VL CDR1, CDR2 and CDR3 of P1-061029;

(b) a VH comprising the amino acid sequence of the VH CDR1, CDR2 and CDR3 of P1-061015 and a VL comprising the VL CDR1, CDR2 and CDR3 of P1-061015;

(c) a VH comprising the amino acid sequence of the VH CDR1, CDR2 and CDR3 of P1-068757 and a VL comprising the VL CDR1, CDR2 and CDR3 of P1-068757;

(d) a VH comprising the amino acid sequence of the VH CDR1, CDR2 and CDR3 of P1-068759 and a VL comprising the VL CDR1, CDR2 and CDR3 of P1-068759;

(e) a VH comprising the amino acid sequence of the VH CDR1, CDR2 and CDR3 of P1-068761 and a VL comprising the VL CDR1, CDR2 and CDR3 of P1-068761;

(f) a VH comprising the amino acid sequence of the VH CDR1, CDR2 and CDR3 of P1-068763 and a VL comprising the VL CDR1, CDR2 and CDR3 of P1-068763;

(g) a VH comprising the amino acid sequence of the VH CDR1, CDR2 and CDR3 of P1-068765 and a VL comprising the VL CDR1, CDR2 and CDR3 of P1-068765;

(h) a VH comprising the amino acid sequence of the VH CDR1, CDR2 and CDR3 of P1-068767 and a VL comprising the VL CDR1, CDR2 and CDR3 of P1-068767;

(i) a VH comprising the amino acid sequence of the VH CDR1, CDR2 and CDR3 of P1-068769 and a VL comprising the VL CDR1, CDR2 and CDR3 of P1-068769;

(j) a VH comprising the amino acid sequence of the VH CDR1, CDR2 and CDR3 of P1-068771 and a VL comprising the VL CDR1, CDR2 and CDR3 of P1-068771;

(k) a VH comprising the amino acid sequence of the VH CDR1, CDR2 and CDR3 of P1-068773 and a VL comprising the VL CDR1, CDR2 and CDR3 of P1-068773;

(l) a VH comprising the amino acid sequence of the VH CDR1, CDR2 and CDR3 of P1-068775 and a VL comprising the VL CDR1, CDR2 and CDR3 of P1-068775;

(m) a VH comprising the amino acid sequence of the VH CDR1, CDR2 and CDR3 of P1-069059 and a VL comprising the VL CDR1, CDR2 and CDR3 of P1-069059;

(n) a VH comprising the amino acid sequence of the VH CDR1, CDR2 and CDR3 of P1-069061 and a VL comprising the VL CDR1, CDR2 and CDR3 of P1-069061;
(o) a VH comprising the amino acid sequence of the VH CDR1, CDR2 and CDR3 of P1-069063 and a VL comprising the VL CDR1, CDR2 and CDR3 of P1-069063;
(p) a VH comprising the amino acid sequence of the VH CDR1, CDR2 and CDR3 of P1-069065 and a VL comprising the VL CDR1, CDR2 and CDR3 of P1-069065;
(q) a VH comprising the amino acid sequence of the VH CDR1, CDR2 and CDR3 of P1-069067 and a VL comprising the VL CDR1, CDR2 and CDR3 of P1-069067;
(r) a VH comprising the amino acid sequence of the VH CDR1, CDR2 and CDR3 of P1-069069 and a VL comprising the VL CDR1, CDR2 and CDR3 of P1-069069;
(s) a VH comprising the amino acid sequence of the VH CDR1, CDR2 and CDR3 of P1-069071 and a VL comprising the VL CDR1, CDR2 and CDR3 of P1-069071;
(t) a VH comprising the amino acid sequence of the VH CDR1, CDR2 and CDR3 of P1-069073 and a VL comprising the VL CDR1, CDR2 and CDR3 of P1-069073;
(u) a VH comprising the amino acid sequence of the VH CDR1, CDR2 and CDR3 of P1-069075 and a VL comprising the VL CDR1, CDR2 and CDR3 of P1-069075;
(v) a VH comprising the amino acid sequence of the VH CDR1, CDR2 and CDR3 of P1-069077 and a VL comprising the VL CDR1, CDR2 and CDR3 of P1-069077;
(w) a VH comprising the amino acid sequence of the VH CDR1, CDR2 and CDR3 of P1-068736 and a VL comprising the VL CDR1, CDR2 and CDR3 of P1-068736;
(x) a VH comprising the amino acid sequence of the VH CDR1, CDR2 and CDR3 of P1-068738 and a VL comprising the VL CDR1, CDR2 and CDR3 of P1-068738;
(y) a VH comprising the amino acid sequence of the VH CDR1, CDR2 and CDR3 of P1-068740 and a VL comprising the VL CDR1, CDR2 and CDR3 of P1-068740;
(z) a VH comprising the amino acid sequence of the VH CDR1, CDR2 and CDR3 of P1-068742 and a VL comprising the VL CDR1, CDR2 and CDR3 of P1-068742;
(aa) a VH comprising the amino acid sequence of the VH CDR1, CDR2 and CDR3 of P1-068744 and a VL comprising the VL CDR1, CDR2 and CDR3 of P1-068744;
(bb) a VH comprising the amino acid sequence of the VH CDR1, CDR2 and CDR3 of P1-068746 and a VL comprising the VL CDR1, CDR2 and CDR3 of P1-068746;
(cc) a VH comprising the amino acid sequence of the VH CDR1, CDR2 and CDR3 of P1-068748 and a VL comprising the VL CDR1, CDR2 and CDR3 of P1-068748;
(dd) a VH comprising the amino acid sequence of the VH CDR1, CDR2 and CDR3 of P1-068750 and a VL comprising the VL CDR1, CDR2 and CDR3 of P1-068750;
(ee) a VH comprising the amino acid sequence of the VH CDR1, CDR2 and CDR3 of P1-068752 and a VL comprising the VL CDR1, CDR2 and CDR3 of P1-068752;
(ff) a VH comprising the amino acid sequence of the VH CDR1, CDR2 and CDR3 of P1-068754 and a VL comprising the VL CDR1, CDR2 and CDR3 of P1-068754;
(gg) a VH comprising the amino acid sequence of the VH CDR1, CDR2 and CDR3 of P1-068761_E55A and a VL comprising the VL CDR1, CDR2 and CDR3 of P1-068761_E55A;
(hh) a VH comprising the amino acid sequence of the VH CDR1, CDR2 and CDR3 of P1-068761_H100G and a VL comprising the VL CDR1, CDR2 and CDR3 of P1-068761_H100G;
(ii) a VH comprising the amino acid sequence of the VH CDR1, CDR2 and CDR3 of P1-068761_E56N and a VL comprising the VL CDR1, CDR2 and CDR3 of P1-068761_E56N;
(jj) a VH comprising the amino acid sequence of the VH CDR1, CDR2 and CDR3 of P1-068761_E55A_E56N and a VL comprising the VL CDR1, CDR2 and CDR3 of P1-068761_E55A_E56N;
(kk) a VH comprising the amino acid sequence of the VH CDR1, CDR2 and CDR3 of P1-068761_E30D and a VL comprising the VL CDR1, CDR2 and CDR3 of P1-068761_E30D;
(ll) a VH comprising the amino acid sequence of the VH CDR1, CDR2 and CDR3 of P1-068761_E30D_E55A and a VL comprising the VL CDR1, CDR2 and CDR3 of P1-068761_E30D_E55A;
(mm) a VH comprising the amino acid sequence of the VH CDR1, CDR2 and CDR3 of P1-068761_E56N_H100G and a VL comprising the VL CDR1, CDR2 and CDR3 of P1-068761_E56N_H100G;
(nn) a VH comprising the amino acid sequence of the VH CDR1, CDR2 and CDR3 of P1-068761_E30D_H100G and a VL comprising the VL CDR1, CDR2 and CDR3 of P1-068761_E30D_H100G;
(oo) a VH comprising the amino acid sequence of the VH CDR1, CDR2 and CDR3 of P1-068761_E30D_E56N and a VL comprising the VL CDR1, CDR2 and CDR3 of P1-068761_E30D_E56N;
(pp) a VH comprising the amino acid sequence of the VH CDR1, CDR2 and CDR3 of P1-068761_E100fF and a VL comprising the VL CDR1, CDR2 and CDR3 of P1-068761_E100fF;
(qq) a VH comprising the amino acid sequence of the VH CDR1, CDR2 and CDR3 of P1-068761_E55A_E100fF and a VL comprising the VL CDR1, CDR2 and CDR3 of P1-068761_E55A_E100fF;
(rr) a VH comprising the amino acid sequence of the VH CDR1, CDR2 and CDR3 of P1-068761_H100G_E100fF and a VL comprising the VL CDR1, CDR2 and CDR3 of P1-068761_H100G_E100fF;
(ss) a VH comprising the amino acid sequence of the VH CDR1, CDR2 and CDR3 of P1-068761_E30D_E100fF and a VL comprising the VL CDR1, CDR2 and CDR3 of P1-068761_E30D_E100fF;

(tt) a VH comprising the amino acid sequence of the VH CDR1, CDR2 and CDR3 of P1-068761_E56N_E100fF and a VL comprising the VL CDR1, CDR2 and CDR3 of P1-068761_E56N_E100fF;

(uu) a VH comprising the amino acid sequence of the VH CDR1, CDR2 and CDR3 of P1-068761_E32Y and a VL comprising the VL CDR1, CDR2 and CDR3 of P1-068761_E32Y;

(vv) a VH comprising the amino acid sequence of the VH CDR1, CDR2 and CDR3 of P1-068761_E32Y_E55A and a VL comprising the VL CDR1, CDR2 and CDR3 of P1-068761_E32Y_E55A;

(ww) a VH comprising the amino acid sequence of the VH CDR1, CDR2 and CDR3 of P1-068761_E32Y_E56N and a VL comprising the VL CDR1, CDR2 and CDR3 of P1-068761_E32Y_E56N;

(xx) a VH comprising the amino acid sequence of the VH CDR1, CDR2 and CDR3 of P1-068761_E30D_E32Y and a VL comprising the VL CDR1, CDR2 and CDR3 of P1-068761_E30D_E32Y;

(yy) a VH comprising the amino acid sequence of the VH CDR1, CDR2 and CDR3 of P1-068761_E32Y_H100G and a VL comprising the VL CDR1, CDR2 and CDR3 of P1-068761_E32Y_H100G;

(zz) a VH comprising the amino acid sequence of the VH CDR1, CDR2 and CDR3 of P1-068761_E32Y_E100fF and a VL comprising the VL CDR1, CDR2 and CDR3 of P1-068761_E32Y_E100fF;

(aaa) a VH comprising the amino acid sequence of the VH CDR1, CDR2 and CDR3 of P1-068767_D52N_D102V and a VL comprising the VL CDR1, CDR2 and CDR3 of P1-068767_D52N_D102V;

(bbb) a VH comprising the amino acid sequence of the VH CDR1, CDR2 and CDR3 of P1-068767_D52N and a VL comprising the VL CDR1, CDR2 and CDR3 of P1-068767_D52N;

(ccc) a VH comprising the amino acid sequence of the VH CDR1, CDR2 and CDR3 of P1-068767_D52N_E55A and a VL comprising the VL CDR1, CDR2 and CDR3 of P1-068767_D52N_E55A;

(ddd) a VH comprising the amino acid sequence of the VH CDR1, CDR2 and CDR3 of P1-068767_E55A_D102V and a VL comprising the VL CDR1, CDR2 and CDR3 of P1-068767_E55A_D102V;

(eee) a VH comprising the amino acid sequence of the VH CDR1, CDR2 and CDR3 of P1-068767_D102V and a VL comprising the VL CDR1, CDR2 and CDR3 of P1-068767_D102V;

(fff) a VH comprising the amino acid sequence of the VH CDR1, CDR2 and CDR3 of P1-068767_E55A and a VL comprising the VL CDR1, CDR2 and CDR3 of P1-068767_E55A;

(ggg) a VH comprising the amino acid sequence of the VH CDR1, CDR2 and CDR3 of P1-068767_E30D_D52N and a VL comprising the VL CDR1, CDR2 and CDR3 of P1-068767_E30D_D52N;

(hhh) a VH comprising the amino acid sequence of the VH CDR1, CDR2 and CDR3 of P1-068767_E30D_D102V and a VL comprising the VL CDR1, CDR2 and CDR3 of P1-068767_E30D_D102V;

(iii) a VH comprising the amino acid sequence of the VH CDR1, CDR2 and CDR3 of P1-068767_E30D and a VL comprising the VL CDR1, CDR2 and CDR3 of P1-068767_E30D;

(jjj) a VH comprising the amino acid sequence of the VH CDR1, CDR2 and CDR3 of P1-068767_E30D_E55A and a VL comprising the VL CDR1, CDR2 and CDR3 of P1-068767_E30D_E55A;

(kkk) a VH comprising the amino acid sequence of the VH CDR1, CDR2 and CDR3 of P1-068767_E100fF_D102V and a VL comprising the VL CDR1, CDR2 and CDR3 of P1-068767_E100fF_D102V;

(lll) a VH comprising the amino acid sequence of the VH CDR1, CDR2 and CDR3 of P1-068767_E55A_E100fF and a VL comprising the VL CDR1, CDR2 and CDR3 of P1-068767_E55A_E100fF;

(mmm) a VH comprising the amino acid sequence of the VH CDR1, CDR2 and CDR3 of P1-068767_D52N_E100fF and a VL comprising the VL CDR1, CDR2 and CDR3 of P1-068767_D52N_E100fF;

(nnn) a VH comprising the amino acid sequence of the VH CDR1, CDR2 and CDR3 of P1-068767_E100fF and a VL comprising the VL CDR1, CDR2 and CDR3 of P1-068767_E100fF;

a VH comprising the amino acid sequence of the VH CDR1, CDR2 and (000) CDR3 of P1-068767_E30D_E100fF and a VL comprising the VL CDR1, CDR2 and CDR3 of P1-068767_E30D_E100fF;

(ppp) a VH comprising the amino acid sequence of the VH CDR1, CDR2 and CDR3 of P1-061029_F100fE_V102D and a VL comprising the VL CDR1, CDR2 and CDR3 of P1-061029_F100fE_V102D;

(qqq) a VH comprising the amino acid sequence of the VH CDR1, CDR2 and CDR3 of P1-061029_F100fE and a VL comprising the VL CDR1, CDR2 and CDR3 of P1-061029_F100fE;

(rrr) a VH comprising the amino acid sequence of the VH CDR1, CDR2 and CDR3 of P1-061029_V102D and a VL comprising the VL CDR1, CDR2 and CDR3 of P1-061029_V102D;

(sss) a VH comprising the amino acid sequence of the VH CDR1, CDR2 and CDR3 of P1-061029_Y32E and a VL comprising the VL CDR1, CDR2 and CDR3 of P1-061029_Y32E;

(ttt) a VH comprising the amino acid sequence of the VH CDR1, CDR2 and CDR3 of P1-061029_Y32E_F100fE and a VL comprising the VL CDR1, CDR2 and CDR3 of P1-061029_Y32E_F100fE;

(uuu) a VH comprising the amino acid sequence of the VH CDR1, CDR2 and CDR3 of P1-068744_E31S and a VL comprising the VL CDR1, CDR2 and CDR3 of P1-068744_E31S;

(vvv) a VH comprising the amino acid sequence of the VH CDR1, CDR2 and CDR3 of P1-068744_H50I and a VL comprising the VL CDR1, CDR2 and CDR3 of P1-068744_H50I;

(www) a VH comprising the amino acid sequence of the VH CDR1, CDR2 and CDR3 of P1-068744_E59Y and a VL comprising the VL CDR1, CDR2 and CDR3 of P1-068744_E59Y;

(xxx) a VH comprising the amino acid sequence of the VH CDR1, CDR2 and CDR3 of P1-068744_E100S and a VL comprising the VL CDR1, CDR2 and CDR3 of P1-068744_E100S;

(yyy) a VH comprising the amino acid sequence of the VH CDR1, CDR2 and CDR3 of P1-068744_E102Y and a VL comprising the VL CDR1, CDR2 and CDR3 of P1-068744_E102Y;

(zzz) a VH comprising the amino acid sequence of the VH CDR1, CDR2 and CDR3 of P1-068744_E31S_H50I and a VL comprising the VL CDR1, CDR2 and CDR3 of P1-068744_E31S_H50I;

(aaaa) a VH comprising the amino acid sequence of the VH CDR1, CDR2 and CDR3 of P1-068744_H50I_E59Y and a VL comprising the VL CDR1, CDR2 and CDR3 of P1-068744_H50I_E59Y;

(bbbb) a VH comprising the amino acid sequence of the VH CDR1, CDR2 and CDR3 of P1-068744_E59Y_E100S and a VL comprising the VL CDR1, CDR2 and CDR3 of P1-068744_E5; 9Y_E100S;

(cccc) a VH comprising the amino acid sequence of the VH CDR1, CDR2 and CDR3 of P1-068744_E100S_E102Y and a VL comprising the VL CDR1, CDR2 and CDR3 of P1-068744_E100S_E102Y;

(dddd) a VH comprising the amino acid sequence of the VH CDR1, CDR2 and CDR3 of P1-068744_E31S_E102Y and a VL comprising the VL CDR1, CDR2 and CDR3 of P1-068744_E31S_E102Y;

(eeee) a VH comprising the amino acid sequence of the VH CDR1, CDR2 and CDR3 of P1-068744_E31S_E59Y and a VL comprising the VL CDR1, CDR2 and CDR3 of P1-068744_E31S_E59Y;

(ffff) a VH comprising the amino acid sequence of the VH CDR1, CDR2 and CDR3 of P1-068744_E31S_E100S and a VL comprising the VL CDR1, CDR2 and CDR3 of P1-068744_E31S_E100S;

(gggg) a VH comprising the amino acid sequence of the VH CDR1, CDR2 and CDR3 of P1-068744_H50I_E100S and a VL comprising the VL CDR1, CDR2 and CDR3 of P1-068744_H50I_E100S;

(hhhh) a VH comprising the amino acid sequence of the VH CDR1, CDR2 and CDR3 of P1-068744_H50I_E102Y and a VL comprising the VL CDR1, CDR2 and CDR3 of P1-068744_H50I_E102Y;

(iiii) a VH comprising the amino acid sequence of the VH CDR1, CDR2 and CDR3 of P1-068744_E59Y_E102Y and a VL comprising the VL CDR1, CDR2 and CDR3 of P1-068744_E59Y_E102Y;

(jjjj) a VH comprising the amino acid sequence of the VH CDR1, CDR2 and CDR3 of P1-068748_H31S and a VL comprising the VL CDR1, CDR2 and CDR3 of P1-068748_H31S;

(kkkk) a VH comprising the amino acid sequence of the VH CDR1, CDR2 and CDR3 of P1-068748_H32Y and a VL comprising the VL CDR1, CDR2 and CDR3 of P1-068748_H32Y;

(llll) a VH comprising the amino acid sequence of the VH CDR1, CDR2 and CDR3 of P1-068748_D57K and a VL comprising the VL CDR1, CDR2 and CDR3 of P1-068748_D57K;

(mmmm) a VH comprising the amino acid sequence of the VH CDR1, CDR2 and CDR3 of P1-068748_D58Y and a VL comprising the VL CDR1, CDR2 and CDR3 of P1-068748_D58Y;

(nnnn) a VH comprising the amino acid sequence of the VH CDR1, CDR2 and CDR3 of P1-068748_D100S and a VL comprising the VL CDR1, CDR2 and CDR3 of P1-068748_D100S;

(oooo) a VH comprising the amino acid sequence of the VH CDR1, CDR2 and CDR3 of P1-068748_H31S_H32Y and a VL comprising the VL CDR1, CDR2 and CDR3 of P1-068748_H31S_H32Y;

(pppp) a VH comprising the amino acid sequence of the VH CDR1, CDR2 and CDR3 of P1-068748_H32Y_D57K and a VL comprising the VL CDR1, CDR2 and CDR3 of P1-068748_H32Y_D57K;

(qqqq) a VH comprising the amino acid sequence of the VH CDR1, CDR2 and CDR3 of P1-068748_D57K_D58Y and a VL comprising the VL CDR1, CDR2 and CDR3 of P1-068748_D57K_D58Y;

(rrrr) a VH comprising the amino acid sequence of the VH CDR1, CDR2 and CDR3 of P1-068748_D58Y_D100S and a VL comprising the VL CDR1, CDR2 and CDR3 of P1-068748_D58Y_D100S;

(ssss) a VH comprising the amino acid sequence of the VH CDR1, CDR2 and CDR3 of P1-068748_H31S_D57K and a VL comprising the VL CDR1, CDR2 and CDR3 of P1-068748_H31S_D57K;

(tttt) a VH comprising the amino acid sequence of the VH CDR1, CDR2 and CDR3 of P1-068748_H31S_D58Y and a VL comprising the VL CDR1, CDR2 and CDR3 of P1-068748_H31S_D58Y;

(uuuu) a VH comprising the amino acid sequence of the VH CDR1, CDR2 and CDR3 of P1-068748_H31S_D100S and a VL comprising the VL CDR1, CDR2 and CDR3 of P1-068748_H31S_D100S;

(vvvv) a VH comprising the amino acid sequence of the VH CDR1, CDR2 and CDR3 of P1-068748_H32Y_D58Y and a VL comprising the VL CDR1, CDR2 and CDR3 of P1-068748_H32Y_D58Y;

(wwww) a VH comprising the amino acid sequence of the VH CDR1, CDR2 and CDR3 of P1-068748_H32Y_D100S and a VL comprising the VL CDR1, CDR2 and CDR3 of P1-068748_H32Y_D100S; or (xxxx) a VH comprising the amino acid sequence of the VH CDR1, CDR2 and CDR3 of P1-068748_D57K_D100S and a VL comprising the VL CDR1, CDR2 and CDR3 of P1-068748_D57K_D100S.

Again, the Sequence Table below provides the heavy and light chain variable region sequences and full length heavy and light chain sequences of the antibodies listed above with an IgG1.3 heavy chain constant region (unless a different HC constant region is noted in the table) and notes the locations of their VH CDR1, CDR2, and CDR3 and VL CDR1, CDR2, and CDR3 by amino acid residue and with bolding and underlining of the CDRs in each VH and VL sequence. Thus, for example, VH CDR1 of P1-061029 comprises amino acids 26-35 of SEQ ID NO: 67, while VH CDR2 comprises amino acids 50-66 of SEQ ID NO: 67, and VH CDR3 comprises amino acids 99-110 of SEQ ID NO: 67, and so forth, as noted by the bolded and underlined amino acids of SEQ ID NO: 67 shown in the Sequence Table.

In certain embodiments, an anti-hVISTA Ab comprises a VH comprising the amino acid sequence of the VH of any of the anti-hVISTA Abs provided herein. The individual VH sequences for particular antibody species provided herein are listed in the Sequence Table. In certain embodiments, an anti-hVISTA Ab comprises a VH comprising the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

In some embodiments, an anti-hVISTA Ab comprises the VH of any of antibodies P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, but with 1, 2, 3, 4, or 5 amino acid substitutions in the framework regions of the VH sequence, such as 1, 2, 3, 4, or 5 conservative substitutions. Optionally, P1-061029 or its progeny may contain a substitution of K16R and/or T84A in the VH framework regions (P1-061015 already has an R and A at those positions).

In certain embodiments, an anti-h VISTA Ab comprises a VH CDR1, CDR2, and CDR3 comprising the amino acid sequences of the VH CDRs of any of the anti-hVISTA Abs provided herein and comprises a VH that is at least 90%, at least 91%, at least 92%, at least 93%, at least 94%, at least 95%, at least 96%, at least 97%, at least 98%, or at least 99% identical to the VH of any of the anti-h VISTA Abs provided herein. In certain embodiments, an anti-h VISTA Ab comprises a VH comprising an amino acid sequence that is at least 90%, at least 91%, at least 92%, at least 93%, at least 94%, at least 95%, at least 96%, at least 97%, at least 98%, or at least 99% identical to the amino acid sequence of the VH of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. In certain embodiments, the VH of the antibody differs from that of the VH sequences shown in the Sequence Table due to 1, 2, 3, 4, or 5 amino acid substitutions in the framework regions of the VH sequence, such as 1, 2, 3, 4, or 5 conservative substitutions, or such as one or both of K16R and/or T84A substitutions in P1-061029 or its progeny.

In certain embodiments, an anti-hVISTA Ab comprises a VH consisting of the amino acid sequence of the VH of any of the anti-hVISTA Abs provided herein. In certain embodiments, an anti-hVISTA Ab comprises a VH that consists of the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, optionally with one or both of K16R and/or T84A substitutions in the case of P1-061029 or its progeny.

In certain embodiments, an anti-hVISTA Ab comprises a VL comprising the amino acid sequence of the VL of any of the anti-hVISTA Abs provided herein. In certain embodiments, an anti-hVISTA Ab comprises a VL comprising the amino acid sequence of the VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. In certain embodiments, an anti-hVISTA Ab comprises a VL CDR1, CDR2, and CDR3 comprising the amino acid sequences of the VL CDRs of any of the anti-hVISTA Abs provided herein and comprises a VL that is at least 90%, at least 91%, at least 92%, at least 93%, at least 94%, at least 95%, at least 96%, at least 97%, at least 98%, or at least 99% identical to the VL of any of the anti-hVISTA Abs provided herein. In certain embodiments, an anti-hVISTA Ab comprises a VL comprising an amino acid sequence that is at least 90%, at least 91%, at least 92%, at least 93%, at least 94%, at least 95%, at least 96%, at least 97%, at least 98%, or at least 99% identical to the amino acid sequence of the VL of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S. In certain embodiments, the VL of the antibody differs from that of the VL sequences shown in the Sequence Table due to 1, 2, 3, 4, or 5 amino acid substitutions in the framework regions of the VL sequence, such as 1, 2, 3, 4, or 5 conservative substitutions. For example, P1-061015 or its progeny may optionally have a T85V substitution in the VL framework region.

In certain embodiments, an anti-hVISTA Ab comprises a VL consisting of the amino acid sequence of the VL of any of the anti-hVISTA Abs provided herein. In certain embodiments, an anti-hVISTA Ab comprises a VL that consists of the amino acid sequence of the VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761 E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

In certain embodiments, an anti-hVISTA Ab comprises a VH comprising the amino acid sequence of the VH of any of the anti-hVISTA Abs provided herein and comprises a VL comprising the amino acid sequence of the VL of any of the anti-hVISTA Abs provided herein. In certain of these embodiments, an anti-hVISTA Ab comprises a VH comprising the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S; and a VL comprising the amino acid sequence of the VL of P1-061029 (SEQ ID NO: 68) or P1-061015 (SEQ ID NO: 96) or P1-061015 comprising a T85V substitution (see SEQ ID NO: 569; P1-061015 T85V).

In certain embodiments, however, the VH of the antibody is that of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, but with 1, 2, 3, 4, or 5 amino acid substitutions in the framework regions of the VH sequence, such as 1, 2, 3, 4, or 5 conservative substitutions, and the VL is that of P1-061029 or P1-061015 or P1-061015 T85V.

In certain embodiments, an anti-hVISTA Ab comprises a VH and a VL comprising the amino acid sequences of the VH and VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, optionally, wherein the VH of P1-061029 or its progeny comprises one or both of K16R and/or T84A substitutions, and further optionally wherein the VL of P1-061015 or its progeny comprises a T85V substitution.

In certain embodiments, an anti-hVISTA Ab comprises a VH CDR1, CDR2, and CDR3 comprising the amino acid sequences of the VH CDRs of any of the anti-hVISTA Abs provided herein as well as a VL CDR1, CDR2, and CDR3 comprising the amino acid sequences of the VL CDRs of any of the anti-hVISTA Abs provided herein, and also comprises a VH and a VL that are each at least 90%, at least 91%, at least 92%, at least 93%, at least 94%, at least 95%, at least 96%, at least 97%, at least 98%, or at least 99% identical to the corresponding VH and VL of any of the anti-h VISTA Abs provided herein. In certain embodiments, the VH and the VL of the antibody differ from the VH and VL sequences shown in the Sequence Table due to 1, 2, 3, 4, or 5 amino acid substitutions in the framework regions of the sequences, such as 1, 2, 3, 4, or 5 conservative substitutions, or such as one or both of K16R and/or T84A substitutions in the VH sequence in the case of P1-061029 or its progeny, or such as a T85V substitution in the case of P1-061015 or its progeny.

In certain embodiments, an anti-hVISTA Ab comprises a VH and a VL consisting of the amino acid sequence of the VH and VL of any of the anti-hVISTA Abs provided herein. In certain embodiments, an anti-hVISTA Ab comprises a VH and a VL that each consist of the amino acid sequences of the VH and VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, optionally, wherein the VH or P1-061029 or its progeny is modified by having one or both of K16R and/or T84A substitutions and the VL of P1-061015 or its progeny is modified by having a T85V substitution.

An anti-hVISTA Ab may comprise:

(a) a VH comprising the amino acid sequence of the VH of P1-061029 and a VL comprising the amino acid sequence of the VL of P1-061029;
(b) a VH comprising the amino acid sequence of the VH of P1-061015 and a VL comprising the amino acid sequence of the VL of P1-061015;
(c) a VH comprising the amino acid sequence of the VH of P1-068757 and a VL comprising the amino acid sequence of the VL of P1-068757;
(d) a VH comprising the amino acid sequence of the VH of P1-068759 and a VL comprising the amino acid sequence of the VL of P1-068759;
(e) a VH comprising the amino acid sequence of the VH of P1-068761 and a VL comprising the amino acid sequence of the VL of P1-068761;
(f) a VH comprising the amino acid sequence of the VH of P1-068763 and a VL comprising the amino acid sequence of the VL of P1-068763;
(g) a VH comprising the amino acid sequence of the VH of P1-068765 and a VL comprising the amino acid sequence of the VL of P1-068765;
(h) a VH comprising the amino acid sequence of the VH of P1-068767 and a VL comprising the amino acid sequence of the VL of P1-068767;
(i) a VH comprising the amino acid sequence of the VH of P1-068769 and a VL comprising the amino acid sequence of the VL of P1-068769;
(j) a VH comprising the amino acid sequence of the VH of P1-068771 and a VL comprising the amino acid sequence of the VL of P1-068771;
(k) a VH comprising the amino acid sequence of the VH of P1-068773 and a VL comprising the amino acid sequence of the VL of –068773;
(l) a VH comprising the amino acid sequence of the VH of P1-068775 and a VL comprising the amino acid sequence of the VL of P1-068775;
(m) a VH comprising the amino acid sequence of the VH of P1-069059 and a VL comprising the amino acid sequence of the VL of P1-069059;
(n) a VH comprising the amino acid sequence of the VH of P1-069061 and a VL comprising the amino acid sequence of the VL of P1-069061;
(o) a VH comprising the amino acid sequence of the VH of P1-069063 and a VL comprising the amino acid sequence of the VL of P1-069063;
(p) a VH comprising the amino acid sequence of the VH of P1-069065 and a VL comprising the amino acid sequence of the VL of P1-069065;
(q) a VH comprising the amino acid sequence of the VH of P1-069067 and a VL comprising the amino acid sequence of the VL of P1-069067;
(r) a VH comprising the amino acid sequence of the VH of P1-069069 and a VL comprising the amino acid sequence of the VL of P1-069069;
(s) a VH comprising the amino acid sequence of the VH of P1-069071 and a VL comprising the amino acid sequence of the VL of P1-069071;
(t) a VH comprising the amino acid sequence of the VH of P1-069073 and a VL comprising the amino acid sequence of the VL of P1-069073;
(u) a VH comprising the amino acid sequence of the VH of P1-069075 and a VL comprising the amino acid sequence of the VL of P1-069075;
(v) a VH comprising the amino acid sequence of the VH of P1-069077 and a VL comprising the amino acid sequence of the VL of P1-069077;
(w) a VH comprising the amino acid sequence of the VH of P1-068736 and a VL comprising the amino acid sequence of the VL of P1-068736;
(x) a VH comprising the amino acid sequence of the VH of P1-068738 and a VL comprising the amino acid sequence of the VL of P1-068738;
(y) a VH comprising the amino acid sequence of the VH of P1-068740 and a VL comprising the amino acid sequence of the VL of P1-068740;
(z) a VH comprising the amino acid sequence of the VH of P1-068742 and a VL comprising the amino acid sequence of the VL of P1-068742;
(aa) a VH comprising the amino acid sequence of the VH of P1-068744 and a VL comprising the amino acid sequence of the VL of P1-068744;
(bb) a VH comprising the amino acid sequence of the VH f P1-068746 and a VL comprising the amino acid sequence of the VL of P1-068746;
(cc) a VH comprising the amino acid sequence of the VH of P1-068748 and a VL comprising the amino acid sequence of the VL of P1-068748;
(dd) a VH comprising the amino acid sequence of the VH of P1-068750 and a VL comprising the amino acid sequence of the VL of P1-068750;
(ee) a VH comprising the amino acid sequence of the VH of P1-068752 and a VL comprising the amino acid sequence of the VL of P1-068752;
(ff) a VH comprising the amino acid sequence of the VH of P1-068754 and a VL comprising the amino acid sequence of the VL of P1-068754;
(gg) a VH comprising the amino acid sequence of the VH of P1-068761_E55A and a VL comprising the amino acid sequence of the VL of P1-068761_E55A;
(hh) a VH comprising the amino acid sequence of the VH of P1-068761_H100G and a VL comprising the amino acid sequence of the VL of P1-068761_H100G;
(ii) a VH comprising the amino acid sequence of the VH of P1-068761_E56N and a VL comprising the amino acid sequence of the VL of P1-068761_E56N;
(jj) a VH comprising the amino acid sequence of the VH of P1-068761_E55A_E56N and a VL comprising the amino acid sequence of the VL of P1-068761_E55A_E56N;
(kk) a VH comprising the amino acid sequence of the VH of P1-068761_E30D and a VL comprising the amino acid sequence of the VL of P1-068761_E30D;

(ll) a VH comprising the amino acid sequence of the VH of P1-068761_E30D_E55A and a VL comprising the amino acid sequence of the VL of P1-068761_E30D_E55A;

(mm) a VH comprising the amino acid sequence of the VH of P1-068761_E56N_H100G and a VL comprising the amino acid sequence of the VL of P1-068761_E56N_H100G;

(nn) a VH comprising the amino acid sequence of the VH of P1-068761_E30D_H100G and a VL comprising the amino acid sequence of the VL of P1-068761_E30D_H100G;

(oo) a VH comprising the amino acid sequence of the VH of P1-068761_E30D_E56N and a VL comprising the amino acid sequence of the VL of P1-068761_E30D_E56N;

(pp) a VH comprising the amino acid sequence of the VH of P1-068761_E100fF and a VL comprising the amino acid sequence of the VL of P1-068761_E100fF;

(qq) a VH comprising the amino acid sequence of the VH of P1-068761_E55A_E100fF and a VL comprising the amino acid sequence of the VL of P1-068761_E55A_E100fF;

(rr) a VH comprising the amino acid sequence of the VH of P1-068761_H100G_E100fF and a VL comprising the amino acid sequence of the VL of P1-068761_H100G_E100fF;

(ss) a VH comprising the amino acid sequence of the VH of P1-068761_E30D_E100fF and a VL comprising the amino acid sequence of the VL of P1-068761_E30D_E100fF;

(tt) a VH comprising the amino acid sequence of the VH of P1-068761_E56N_E100fF and a VL comprising the amino acid sequence of the VL of P1-068761_E56N_E100fF;

(uu) a VH comprising the amino acid sequence of the VH of P1-068761_E32Y and a VL comprising the amino acid sequence of the VL of P1-068761_E32Y;

(vv) a VH comprising the amino acid sequence of the VH of P1-068761_E32Y_E55A and a VL comprising the amino acid sequence of the VL of P1-068761_E32Y_E55A;

(ww) a VH comprising the amino acid sequence of the VH of P1-068761_E32Y_E56N and a VL comprising the amino acid sequence of the VL of P1-068761_E32Y_E56N;

(xx) a VH comprising the amino acid sequence of the VH of P1-068761_E30D_E32Y and a VL comprising the amino acid sequence of the VL of P1-068761_E30D_E32Y;

(yy) a VH comprising the amino acid sequence of the VH of P1-068761_E32Y_H100G and a VL comprising the amino acid sequence of the VL of P1-068761_E32Y_H100G;

(zz) a VH comprising the amino acid sequence of the VH of P1-068761_E32Y_E100fF and a VL comprising the amino acid sequence of the VL of P1-068761_E32Y_E100fF;

(aaa) a VH comprising the amino acid sequence of the VH of P1-068767_D52N_D102V and a VL comprising the amino acid sequence of the VL of P1-068767_D52N_D102V;

(bbb) a VH comprising the amino acid sequence of the VH of P1-068767_D52N and a VL comprising the amino acid sequence of the VL of P1-068767_D52N;

(ccc) a VH comprising the amino acid sequence of the VH of P1-068767_D52N_E55A and a VL comprising the amino acid sequence of the VL of P1-068767_D52N_E55A;

(ddd) a VH comprising the amino acid sequence of the VH of P1-068767_E55A_D102V and a VL comprising the amino acid sequence of the VL of P1-068767_E55A_D102V;

(eee) a VH comprising the amino acid sequence of the VH of P1-068767_D102V and a VL comprising the amino acid sequence of the VL of P1-068767_D102V;

(fff) a VH comprising the amino acid sequence of the VH of P1-068767_E55A and a VL comprising the amino acid sequence of the VL of P1-068767_E55A;

(ggg) a VH comprising the amino acid sequence of the VH of P1-068767_E30D_D52N and a VL comprising the amino acid sequence of the VL of P1-068767_E30D_D52N;

(hhh) a VH comprising the amino acid sequence of the VH of P1-068767_E30D_D102V and a VL comprising the amino acid sequence of the VL of P1-068767_E30D_D102V;

(iii) a VH comprising the amino acid sequence of the VH of P1-068767_E30D and a VL comprising the amino acid sequence of the VL of P1-068767_E30D;

(jjj) a VH comprising the amino acid sequence of the VH of P1-068767_E30D_E55A and a VL comprising the amino acid sequence of the VL of P1-068767_E30D_E55A;

(kkk) a VH comprising the amino acid sequence of the VH of P1-068767_E100fF_D102V and a VL comprising the amino acid sequence of the VL of P1-068767_E100fF_D102V;

(lll) a VH comprising the amino acid sequence of the VH of P1-068767_E55A_E100fF and a VL comprising the amino acid sequence of the VL of P1-068767_E55A_E100fF;

(mmm) a VH comprising the amino acid sequence of the VH of P1-068767_D52N_E100fF and a VL comprising the amino acid sequence of the VL of P1-068767_D52N_E100fF;

(nnn) a VH comprising the amino acid sequence of the VH of P1-068767_E100fF and a VL comprising the amino acid sequence of the VL of P1-068767_E100fF;

(ooo) a VH comprising the amino acid sequence of the VH of P1-068767_E30D_E100fF and a VL comprising the amino acid sequence of the VL of P1-068767_E30D_E100fF;

(ppp) a VH comprising the amino acid sequence of the VH of P1-061029_F100fE_V102D and a VL comprising the amino acid sequence of the VL of P1-061029_F100fE_V102D;

(qqq) a VH comprising the amino acid sequence of the VH of P1-061029_F100fE and a VL comprising the amino acid sequence of the VL of P1-061029_F100fE;

(rrr) a VH comprising the amino acid sequence of the VH of P1-061029_V102D and a VL comprising the amino acid sequence of the VL of P1-061029_V102D;

(sss) a VH comprising the amino acid sequence of the VH of P1-061029_Y32E and a VL comprising the amino acid sequence of the VL of P1-061029_Y32E;

(ttt) a VH comprising the amino acid sequence of the VH of P1-061029_Y32E_F100fE and a VL comprising the amino acid sequence of the VL of P1-061029_Y32E_F100fE;

(uuu) a VH comprising the amino acid sequence of the VH of P1-068744_E31S and a VL comprising the VL of P1-068744_E31S;

(vvv) a VH comprising the amino acid sequence of the VH of P1-068744_H50I and a VL comprising the VL of P1-068744_H50I;

(www) a VH comprising the amino acid sequence of the VH of P1-068744_E59Y and a VL comprising the VL of P1-068744_E59Y;

(xxx) a VH comprising the amino acid sequence of the VH of P1-068744_E100S and a VL comprising the VL of P1-068744_E100S;

(yyy) a VH comprising the amino acid sequence of the VH of P1-068744_E102Y and a VL comprising the VL of P1-068744_E102Y;

(zzz) a VH comprising the amino acid sequence of the VH of P1-068744_E31S_H50I and a VL comprising the VL of P1-068744_E31S_H50I;

(aaaa) a VH comprising the amino acid sequence of the VH of P1-068744_H50I_E59Y and a VL comprising the VL of P1-068744_H50I_E59Y;

(bbbb) a VH comprising the amino acid sequence of the VH of P1-068744_E59Y_E100S and a VL comprising the VL of P1-068744_E5;9Y_E100S;

(cccc) a VH comprising the amino acid sequence of the VH of P1-068744_E100S_E102Y and a VL comprising the VL of P1-068744_E100S_E102Y;

(dddd) a VH comprising the amino acid sequence of the VH of P1-068744_E31S_E102Y and a VL comprising the VL of P1-068744_E31S_E102Y;

(eeee) a VH comprising the amino acid sequence of the VH of P1-068744_E31S_E59Y and a VL comprising the VL of P1-068744_E31S_E59Y;

(ffff) a VH comprising the amino acid sequence of the VH of P1-068744_E31S_E100S and a VL comprising the VL of P1-068744_E31S_E100S;

(gggg) a VH comprising the amino acid sequence of the VH of P1-068744_H50I_E100S and a VL comprising the VL of P1-068744_H50I_E100S;

(hhhh) a VH comprising the amino acid sequence of the VH of P1-068744_H50I_E102Y and a VL comprising the VL of P1-068744_H50I_E102Y;

(iiii) a VH comprising the amino acid sequence of the VH of P1-(iiii) 068744_E59Y_E102Y and a VL comprising the VL of P1-068744_E59Y_E102Y;

(jjjj) a VH comprising the amino acid sequence of the VH of P1-068748_H31S and a VL comprising the VL of P1-068748_H31S;

(kkkk) a VH comprising the amino acid sequence of the VH of P1-068748_H32Y and a VL comprising the VL of P1-068748_H32Y;

(llll) a VH comprising the amino acid sequence of the VH of P1-068748_D57K and a VL comprising the VL of P1-068748_D57K;

(mmmm) a VH comprising the amino acid sequence of the VH of P1-068748_D58Y and a VL comprising the VL of P1-068748_D58Y;

(nnnn) a VH comprising the amino acid sequence of the VH of P1-068748_D100S and a VL comprising the VL of P1-068748_D100S;

(oooo) a VH comprising the amino acid sequence of the VH of P1-068748_H31S_H32Y and a VL comprising the VL of P1-068748_H31S_H32Y;

(pppp) a VH comprising the amino acid sequence of the VH of P1-068748_H32Y_D57K and a VL comprising the VL of P1-068748_H32Y_D57K;

(qqqq) a VH comprising the amino acid sequence of the VH of P1-068748_D57K_D58Y and a VL comprising the VL of P1-068748_D57K_D58Y;

(rrrr) a VH comprising the amino acid sequence of the VH of P1-068748_D58Y_D100S and a VL comprising the VL of P1-068748_D58Y_D100S;

(ssss) a VH comprising the amino acid sequence of the VH of P1-068748_H31S_D57K and a VL comprising the VL of P1-068748_H31S_D57K;

(tttt) a VH comprising the amino acid sequence of the VH of P1-068748_H31S_D58Y and a VL comprising the VL of P1-068748_H31S_D58Y;

(uuuu) a VH comprising the amino acid sequence of the VH of P1-068748_H31S_D100S and a VL comprising the VL of P1-068748_H31S_D100S;

(vvvv) a VH comprising the amino acid sequence of the VH of P1-068748_H32Y_D58Y and a VL comprising the VL of P1-068748_H32Y_D58Y;

(wwww) a VH comprising the amino acid sequence of the VH of P1-068748_H32Y_D100S and a VL comprising the VL of P1-068748_H32Y_D100S; or (xxxx) a VH comprising the amino acid sequence of the VH of P1-068748_D57K_D100S and a VL comprising the VL of P1-068748_D57K_D100S, optionally wherein the VH of (a) or (c)-(ttt) comprises one or both of K16R and T84A substitutions, and optionally wherein the VL of (b) or (uuu)-(xxxx) comprises a T85V substitution.

An anti-hVISTA Ab may comprise:

(a) a VH comprising the amino acid sequence of the VH of P1-061029 modified by K16R and/or T84A substitutions, and a VL comprising the amino acid sequence of the VL of P1-061029;

(b) a VH comprising the amino acid sequence of the VH of P1-068757 modified by K16R and/or T84A substitutions, and a VL comprising the amino acid sequence of the VL of P1-068757;

(c) a VH comprising the amino acid sequence of the VH of P1-068759 modified by K16R and/or T84A substitutions, and a VL comprising the amino acid sequence of the VL of P1-068759;

(d) a VH comprising the amino acid sequence of the VH of P1-068761 modified by K16R and/or T84A substitutions, and a VL comprising the amino acid sequence of the VL of P1-068761;

(e) a VH comprising the amino acid sequence of the VH of P1-068763 modified by K16R and/or T84A substitutions, and a VL comprising the amino acid sequence of the VL of P1-068763;

(f) a VH comprising the amino acid sequence of the VH of P1-068765 modified by K16R and/or T84A substitutions, and a VL comprising the amino acid sequence of the VL of P1-068765;

(g) a VH comprising the amino acid sequence of the VH of P1-068767 modified by K16R and/or T84A substitutions, and a VL comprising the amino acid sequence of the VL of P1-068767;

(h) a VH comprising the amino acid sequence of the VH of P1-068769 modified by K16R and/or T84A substitutions, and a VL comprising the amino acid sequence of the VL of P1-068769;

(i) a VH comprising the amino acid sequence of the VH of P1-068771 modified by K16R and/or T84A substitutions, and a VL comprising the amino acid sequence of the VL of P1-068771;

(j) a VH comprising the amino acid sequence of the VH of P1-068773 modified by K16R and/or T84A substitutions, and a VL comprising the amino acid sequence of the VL of –068773;

(k) a VH comprising the amino acid sequence of the VH of P1-068775 modified by K16R and/or T84A substitutions, and a VL comprising the amino acid sequence of the VL of P1-068775;

(l) a VH comprising the amino acid sequence of the VH of P1-069059 modified by K16R and/or T84A substitutions, and a VL comprising the amino acid sequence of the VL of P1-069059;

(m) a VH comprising the amino acid sequence of the VH of P1-069061 modified by K16R and/or T84A substitutions, and a VL comprising the amino acid sequence of the VL of P1-069061;

(n) a VH comprising the amino acid sequence of the VH of P1-069063 modified by K16R and/or T84A substitutions, and a VL comprising the amino acid sequence of the VL of P1-069063;

(o) a VH comprising the amino acid sequence of the VH of P1-069065 modified by K16R and/or T84A substitutions, and a VL comprising the amino acid sequence of the VL of P1-069065;

(p) a VH comprising the amino acid sequence of the VH of P1-069067 modified by K16R and/or T84A substitutions, and a VL comprising the amino acid sequence of the VL of P1-069067;

(q) a VH comprising the amino acid sequence of the VH of P1-069069 modified by K16R and/or T84A substitutions, and a VL comprising the amino acid sequence of the VL of P1-069069;

(r) a VH comprising the amino acid sequence of the VH of P1-069071 modified by K16R and/or T84A substitutions, and a VL comprising the amino acid sequence of the VL of P1-069071;

(s) a VH comprising the amino acid sequence of the VH of P1-069073 modified by K16R and/or T84A substitutions, a VL comprising the amino acid sequence of the VL of P1-069073;

(t) a VH comprising the amino acid sequence of the VH of P1-069075 modified by K16R and/or T84A substitutions, and a VL comprising the amino acid sequence of the VL of P1-069075;

(u) a VH comprising the amino acid sequence of the VH of P1-069077 modified by K16R and/or T84A substitutions, and a VL comprising the amino acid sequence of the VL of P1-069077;

(v) a VH comprising the amino acid sequence of the VH of P1-068761_E55A modified by K16R and/or T84A substitutions, and a VL comprising the amino acid sequence of the VL of P1-068761_E55A;

(w) a VH comprising the amino acid sequence of the VH of P1-068761_H100G modified by K16R and/or T84A substitutions, and a VL comprising the amino acid sequence of the VL of P1-068761_H100G;

(x) a VH comprising the amino acid sequence of the VH of P1-068761_E56N modified by K16R and/or T84A substitutions, and a VL comprising the amino acid sequence of the VL of P1-068761_E56N;

(y) a VH comprising the amino acid sequence of the VH of P1-068761_E55A_E56N sequence of the VL of P1-068761_E55A_E56N;

(z) a VH comprising the amino acid sequence of the VH of P1-068761_E30D modified by K16R and/or T84A substitutions, and a VL comprising the amino acid sequence of the VL of P1-068761_E30D;

(aa) a VH comprising the amino acid sequence of the VH of P1-068761_E30D_E55A modified by K16R and/or T84A substitutions, and a VL comprising the amino acid sequence of the VL of P1-068761_E30D_E55A;

(bb) a VH comprising the amino acid sequence of the VH of P1-068761_E56N_H100G modified by K16R and/or T84A substitutions, and a VL comprising the amino acid sequence of the VL of P1-068761_E56N_H100G;

(cc) a VH comprising the amino acid sequence of the VH of P1-068761_E30D_H100G modified by K16R and/or T84A substitutions, and a VL comprising the amino acid sequence of the VL of P1-068761_E30D_H100G;

(dd) a VH comprising the amino acid sequence of the VH of P1-068761_E30D_E56N modified by K16R and/or T84A substitutions, and a VL comprising the amino acid sequence of the VL of P1-068761_E30D_E56N;

(ee) a VH comprising the amino acid sequence of the VH of P1-068761_E100fF modified by K16R and/or T84A substitutions, and a VL comprising the amino acid sequence of the VL of P1-068761_E100fF;

(ff) a VH comprising the amino acid sequence of the VH of P1-068761_E55A_E100fF modified by K16R and/or T84A substitutions, and a VL comprising the amino acid sequence of the VL of P1-068761_E55A_E100fF;

(gg) a VH comprising the amino acid sequence of the VH of P1-068761_H100G_E100fF modified by K16R and/or T84A substitutions, and a VL comprising the amino acid sequence of the VL of P1-068761_H100G_E100fF;

(hh) a VH comprising the amino acid sequence of the VH of P1-068761_E30D_E100fF modified by K16R and/or T84A substitutions, and a VL comprising the amino acid sequence of the VL of P1-068761_E30D_E100fF;

(ii) a VH comprising the amino acid sequence of the VH of P1-068761_E56N_E100fF sequence of the VL of P1-068761_E56N_E100fF;

(jj) a VH comprising the amino acid sequence of the VH of P1-068761_E32Y modified by K16R and/or T84A substitutions, and a VL comprising the amino acid sequence of the VL of P1-068761_E32Y;

(kk) a VH comprising the amino acid sequence of the VH of P1-068761_E32Y_E55A modified by K16R and/or T84A substitutions, and a VL comprising the amino acid sequence of the VL of P1-068761_E32Y_E55A;

(ll) a VH comprising the amino acid sequence of the VH of P1-068761_E32Y_E56N modified by K16R and/or T84A substitutions, and a VL comprising the amino acid sequence of the VL of P1-068761_E32Y_E56N;

(mm) a VH comprising the amino acid sequence of the VH of P1-068761_E30D_E32Y modified by K16R and/or T84A substitutions, and a VL comprising the amino acid sequence of the VL of P1-068761_E30D_E32Y;

a VH comprising the amino acid sequence of the VH of P1-(nn) 068761_E32Y_H100G modified by K16R and/or T84A substitutions, and a VL comprising the amino acid sequence of the VL of P1-068761_E32Y_H100G;

(oo) a VH comprising the amino acid sequence of the VH of P1-068761_E32Y_E100fF modified by K16R and/or T84A substitutions, and a VL comprising the amino acid sequence of the VL of P1-068761_E32Y_E100fF;

(pp) a VH comprising the amino acid sequence of the VH of P1-068767_D52N_D102V modified by K16R and/or T84A substitutions, and a VL comprising the amino acid sequence of the VL of P1-068767_D52N_D102V;

(qq) a VH comprising the amino acid sequence of the VH of P1-068767_D52N modified by K16R and/or T84A substitutions, and a VL comprising the amino acid sequence of the VL of P1-068767_D52N;

(rr) a VH comprising the amino acid sequence of the VH of P1-068767_D52N_E55A modified by K16R and/or T84A substitutions, and a VL comprising the amino acid sequence of the VL of P1-068767_D52N_E55A;

(ss) a VH comprising the amino acid sequence of the VH of P1-068767_E55A_D102V sequence of the VL of P1-068767_E55A_D102V;

(tt) a VH comprising the amino acid sequence of the VH of P1-068767_D102V modified by K16R and/or T84A substitutions, a VL comprising the amino acid sequence of the VL of P1-068767_D102V;

(uu) a VH comprising the amino acid sequence of the VH of P1-068767_E55A modified by K16R and/or T84A substitutions, and a VL comprising the amino acid sequence of the VL of P1-068767_E55A;

(vv) a VH comprising the amino acid sequence of the VH of P1-068767_E30D_D52N modified by K16R and/or T84A substitutions, and a VL comprising the amino acid sequence of the VL of P1-068767_E30D_D52N;

(ww) a VH comprising the amino acid sequence of the VH of P1-068767_E30D_D102V modified by K16R and/or T84A substitutions, and a VL comprising the amino acid sequence of the VL of P1-068767_E30D_D102V;

(xx) a VH comprising the amino acid sequence of the VH of P1-068767_E30D modified by K16R and/or T84A substitutions, and a VL comprising the amino acid sequence of the VL of P1-068767_E30D;

(yy) a VH comprising the amino acid sequence of the VH of P1-068767_E30D_E55A modified by K16R and/or T84A substitutions, and a VL comprising the amino acid sequence of the VL of P1-068767_E30D_E55A;

(zz) a VH comprising the amino acid sequence of the VH of P1-068767_E100fF_D102V modified by K16R and/or T84A substitutions, and a VL comprising the amino acid sequence of the VL of P1-068767_E100fF_D102V;

(aaa) a VH comprising the amino acid sequence of the VH of P1-068767_E55A_E100fF modified by K16R and/or T84A substitutions, and a VL comprising the amino acid sequence of the VL of P1-068767_E55A_E100fF;

(bbb) a VH comprising the amino acid sequence of the VH of P1-068767_D52N_E100fF modified by K16R and/or T84A substitutions, and a VL comprising the amino acid sequence of the VL of P1-068767_D52N_E100fF;

(ccc) a VH comprising the amino acid sequence of the VH of P1-068767_E100fF modified by K16R and/or T84A substitutions and a VL comprising the amino acid sequence of the VL of P1-068767_E100fF;

(ddd) a VH comprising the amino acid sequence of the VH of P1-068767_E30D_E100fF modified by K16R and/or T84A substitutions and a VL comprising the amino acid sequence of the VL of P1-068767_E30D_E100fF;

(eee) a VH comprising the amino acid sequence of the VH of P1-061029_F100fE_V102D modified by K16R and/or T84A substitutions and a VL comprising the amino acid sequence of the VL of P1-061029_F100fE_V102D;

(fff) a VH comprising the amino acid sequence of the VH of P1-061029_F100fE modified by K16R and/or T84A substitutions and a VL comprising the amino acid sequence of the VL of P1-061029_F100fE;

(ggg) a VH comprising the amino acid sequence of the VH of P1-061029_V102D modified by K16R and/or T84A substitutions and a VL comprising the amino acid sequence of the VL of P1-061029_V102D;

(hhh) a VH comprising the amino acid sequence of the VH of P1-061029_Y32E modified by K16R and/or T84A substitutions and a VL comprising the amino acid sequence of the VL of P1-061029_Y32E; or (iii) a VH comprising the amino acid sequence of the VH of P1-061029_Y32E_F100fE modified by K16R and/or T84A substitutions and a VL comprising the amino acid sequence of the VL of P1-061029_Y32E_F100fE.

An anti-h VISTA Ab may comprise:

(a) a VH comprising the VH CDRs of the VH of P1-061029 and a VL comprising the VL CDRs of P1-061029 and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029;

(b) a VH comprising the VH CDRs of the VH of P1-061015 and a VL comprising the VL CDRs of P1-061015 and VH and VL amino acid sequences that are at least 90%, at least 91%, at least 92%, at least 93%, at least 94%, at least 95%, at least 96%, at least 97%, at least 98%, or at least 99% identical to the VH and VL of P1-061015;

(c) a VH comprising the VH CDRs of the VH of P1-068757 and a VL comprising the VL CDRs of P1-068757 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068757;

(d) a VH comprising the VH CDRs of the VH of P1-068759 and a VL comprising the VL CDRs of P1-068759 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068759;

(e) a VH comprising the VH CDRs of the VH of P1-068761 and a VL comprising the VL CDRs of P1-068761 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761;

(f) a VH comprising the VH CDRs of the VH of P1-068763 and a VL comprising the VL CDRs of P1-068763 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068763;

(g) a VH comprising the VH CDRs of the VH of P1-068765 and a VL comprising the VL CDRs of P1-068765 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068765;

(h) a VH comprising the VH CDRs of the VH of P1-068767 and a VL comprising the VL CDRs of P1-068767 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767;

(i) a VH comprising the VH CDRs of the VH of P1-068769 and a VL comprising the VL CDRs of P1-068769 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068769;

(j) a VH comprising the VH CDRs of the VH of P1-068771 and a VL comprising the VL CDRs of P1-068771 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068771;

(k) a VH comprising the VH CDRs of the VH of P1-068773 and a VL comprising the VL CDRs of P1-068773 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068773;

(l) a VH comprising the VH CDRs of the VH of P1-068775 and a VL comprising the VL CDRs of P1-068775 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068775;

(m) a VH comprising the VH CDRs of the VH of P1-069059 and a VL comprising the VL CDRs of P1-069059 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069059;

(n) a VH comprising the VH CDRs of the VH of P1-069061 and a VL comprising the VL CDRs of P1-069061 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069061;

(o) a VH comprising the VH CDRs of the VH of P1-069063 and a VL comprising the VL CDRs of P1-069063 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069063;

(p) a VH comprising the VH CDRs of the VH of P1-069065 and a VL comprising the VL CDRs of P1-069065 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069065;

(q) a VH comprising the VH CDRs of the VH of P1-069067 and a VL comprising the VL CDRs of P1-069067 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069067;

(r) a VH comprising the VH CDRs of the VH of P1-069069 and a VL comprising the VL CDRs of P1-069069 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069069;

(s) a VH comprising the VH CDRs of the VH of P1-069071 and a VL comprising the VL CDRs of P1-069071 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069071;

(t) a VH comprising the VH CDRs of the VH of P1-069073 and a VL comprising the VL CDRs of P1-069073 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069073;

(u) a VH comprising the VH CDRs of the VH of P1-069075 and a VL comprising the VL CDRs of P1-069075 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069075;

(v) a VH comprising the VH CDRs of the VH of P1-069077 and a VL comprising the VL CDRs of P1-069077 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069077;

(w) a VH comprising the VH CDRs of the VH of P1-068736 and a VL comprising the VL CDRs of P1-068736 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068736;

(x) a VH comprising the VH CDRs of the VH of P1-068738 and a VL comprising the VL CDRs of P1-068738 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068738;

(y) a VH comprising the VH CDRs of the VH of P1-068740 and a VL comprising the VL CDRs of P1-068740 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068740;

(z) a VH comprising the VH CDRs of the VH of P1-068742 and a VL comprising the VL CDRs of P1-068742 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068742;

(aa) a VH comprising the VH CDRs of the VH of P1-068744 and a VL comprising the VL CDRs of P1-068744 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744;

(bb) a VH comprising the VH CDRs of the VH of P1-068746 and a VL comprising the VL CDRs of P1-068746 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068746;

(cc) a VH comprising the VH CDRs of the VH of P1-068748 and a VL comprising the VL CDRs of P1-068748 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748;

(dd) a VH comprising the VH CDRs of the VH of P1-068750 and a VL comprising the VL CDRs of P1-068750 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068750;

(ee) a VH comprising the VH CDRs of the VH of P1-068752 and a VL comprising the VL CDRs of P1-068752 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068752;

(ff) a VH comprising the VH CDRs of the VH of P1-068754 and a VL comprising the VL CDRs of P1-068754 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068754;

(gg) a VH comprising the VH CDRs of the VH of P1-068761_E55A and a VL comprising the VL CDRs of P1-068761_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A;

(hh) a VH comprising the VH CDRs of the VH of P1-068761_H100G and a VL comprising the VL CDRs of P1-068761_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_H100G;

(ii) a VH comprising the VH CDRs of the VH of P1-068761_E56N and a VL comprising the VL CDRs of P1-068761_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E56N;

(jj) a VH comprising the VH CDRs of the VH of P1-068761_E55A_E56N and a VL comprising the VL CDRs of P1-068761_E55A_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A_E56N;

(kk) a VH comprising the VH CDRs of the VH of P1-068761_E30D and a VL comprising the VL CDRs of P1-068761_E30D and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D;

(ll) a VH comprising the VH CDRs of the VH of P1-068761_E30D_E55A and a VL comprising the VL CDRs of P1-068761_E30D_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E55A;

(mm) a VH comprising the VH CDRs of the VH of P1-068761_E56N_H100G and a VL comprising the VL CDRs of P1-068761_E56N_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E56N_H100G;

(nn) a VH comprising the VH CDRs of the VH of P1-068761_E30D_H100G and a VL comprising the VL CDRs of P1-068761_E30D_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_H100G;

(oo) a VH comprising the VH CDRs of the VH of P1-068761_E30D_E56N and a VL comprising the VL CDRs of P1-068761_E30D_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E56N;

(pp) a VH comprising the VH CDRs of the VH of P1-068761_E100fF and a VL comprising the VL CDRs of P1-068761_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E100fF;

(qq) a VH comprising the VH CDRs of the VH of P1-068761_E55A_E100fF and a VL comprising the VL CDRs of P1-068761_E55A_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A_E100fF;

(rr) a VH comprising the VH CDRs of the VH of P1-068761_H100G_E100fF and a VL comprising the VL CDRs of P1-068761_H100G_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_H100G_E100fF;

(ss) a VH comprising the VH CDRs of the VH of P1-068761_E30D_E100fF and a VL comprising the VL CDRs of P1-068761_E30D_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E100fF;

(tt) a VH comprising the VH CDRs of the VH of P1-068761_E56N_E100fF and a VL comprising the VL CDRs of P1-068761_E56N_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E56N_E100fF;

(uu) a VH comprising the VH CDRs of the VH of P1-068761_E32Y and a VL comprising the VL CDRs of P1-068761_E32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y;

(vv) a VH comprising the VH CDRs of the VH of P1-068761_E32Y_E55A and a VL comprising the VL CDRs of P1-068761_E32Y_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E55A;

(ww) a VH comprising the VH CDRs of the VH of P1-068761_E32Y_E56N and a VL comprising the VL CDRs of P1-068761_E32Y_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E56N;

(xx) a VH comprising the VH CDRs of the VH of P1-068761_E30D_E32Y and a VL comprising the VL CDRs of P1-068761_E30D_E32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E32Y;

(yy) a VH comprising the VH CDRs of the VH of P1-068761_E32Y_H100G and a VL comprising the VL CDRs of P1-068761_E32Y_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_H100G;

(zz) a VH comprising the VH CDRs of the VH of P1-068761_E32Y_E100fF and a VL comprising the VL CDRs of P1-068761_E32Y_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E100fF;

(aaa) a VH comprising the VH CDRs of the VH of P1-068767_D52N_D102V and a VL comprising the VL CDRs of P1-068767_D52N_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_D102V;

(bbb) a VH comprising the VH CDRs of the VH of P1-068767_D52N and a VL comprising the VL CDRs of P1-068767_D52N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N;

(ccc) a VH comprising the VH CDRs of the VH of P1-068767_D52N_E55A and a VL comprising the VL CDRs of P1-068767_D52N_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_E55A;

(ddd) a VH comprising the VH CDRs of the VH of P1-068767_E55A_D102V and a VL comprising the VL CDRs of P1-068767_E55A_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A_D102V;

(eee) a VH comprising the VH CDRs of the VH of P1-068767_D102V and a VL comprising the VL CDRs of P1-068767_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D102V;

(fff) a VH comprising the VH CDRs of the VH of P1-068767_E55A and a VL comprising the VL CDRs of P1-068767_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A;

(ggg) a VH comprising the VH CDRs of the VH of P1-068767_E30D_D52N and a VL comprising the VL CDRs of P1-068767_E30D_D52N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_D52N;

(hhh) a VH comprising the VH CDRs of the VH of P1-068767_E30D_D102V and a VL comprising the VL CDRs of P1-068767_E30D_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_D102V;

(iii) a VH comprising the VH CDRs of the VH of P1-068767_E30D and a VL comprising the VL CDRs of P1-068767_E30D and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D;

(jjj) a VH comprising the VH CDRs of the VH of P1-068767_E30D_E55A and a VL comprising the VL CDRs of P1-068767_E30D_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_E55A;

(kkk) a VH comprising the VH CDRs of the VH of P1-068767_E100fF_D102V and a VL comprising the VL CDRs of P1-068767_E100fF_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E100fF_D102V;

(lll) a VH comprising the VH CDRs of the VH of P1-068767_E55A_E100fF and a VL comprising the VL CDRs of P1-068767_E55A_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A_E100fF;

(mmm) a VH comprising the VH CDRs of the VH of P1-068767_D52N_E100fF and a VL comprising the VL CDRs of P1-068767_D52N_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_E100fF;

(nnn) a VH comprising the VH CDRs of the VH of P1-068767_E100fF and a VL comprising the VL CDRs of P1-068767_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E100fF;

(ooo) a VH comprising the VH CDRs of the VH of P1-068767_E30D_E100fF and a VL comprising the VL CDRs of P1-068767_E30D_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_E100fF;

(ppp) a VH comprising the VH CDRs of the VH of P1-061029_F100fE_V102D and a VL comprising the VL CDRs of P1-061029_F100fE_V102D and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_F100fE_V102D;

(qqq) a VH comprising the VH CDRs of the VH of P1-061029_F100fE and a VL comprising the VL CDRs of P1-061029_F100fE and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_F100fE;

(rrr) a VH comprising the VH CDRs of the VH of P1-061029_V102D and a VL comprising the VL CDRs of P1-061029_V102D and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_V102D;

(sss) a VH comprising the VH CDRs of the VH of P1-061029_Y32E and a VL comprising the VL CDRs of P1-061029_Y32E and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_Y32E;

(ttt) a VH comprising the VH CDRs of the VH of P1-061029_Y32E_F100fE and a VL comprising the VL CDRs of P1-061029_Y32E_F100fE and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_Y32E_F100fE;

(uuu) a VH comprising the VH CDRs of the VH of P1-068744_E31S and a VL comprising the VL CDRs of P1-068744_E31S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S;

(vvv) a VH comprising the VH CDRs of the VH of P1-068744_H50I and a VL comprising the VL CDRs of P1-068744_H50I and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_H50I;

(www) a VH comprising the VH CDRs of the VH of P1-068744_E59Y and a VL comprising the VL CDRs of P1-068744_E59Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E59Y;

(xxx) a VH comprising the VH CDRs of the VH of P1-068744_E100S and a VL comprising the VL CDRs of P1-068744_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E100S;

(yyy) a VH comprising the VH CDRs of the VH of P1-068744_E102Y and a VL comprising the VL CDRs of P1-068744_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of;

(zzz) a VH comprising the VH CDRs of the VH of P1-068744_E31S_H50I and a VL comprising the VL CDRs of P1-068744_E31S_H50I and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E102Y;

(aaaa) a VH comprising the VH CDRs of the VH of P1-068744_H50I_E59Y and a VL comprising the VL CDRs of P1-068744_H50I_E59Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E59Y;

(bbbb) a VH comprising the VH CDRs of the VH of P1-068744_E59Y_E100S and a VL comprising the VL CDRs of P1-068744_E5;9Y_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E59Y_E100S;

(cccc) a VH comprising the VH CDRs of the VH of P1-068744_E100S_E102Y and a VL comprising the VL CDRs of P1-068744_E100S_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E100S_E102Y;

(dddd) a VH comprising the VH CDRs of the VH of P1-068744_E31S_E102Y and a VL comprising the VL CDRs of P1-068744_E31S_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E102Y;

(eeee) a VH comprising the VH CDRs of the VH of P1-068744_E31S_E59Y and a VL comprising the VL CDRs of P1-068744_E31S_E59Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E59Y;

(ffff) a VH comprising the VH CDRs of the VH of P1-068744_E31S_E100S and a VL comprising the VL CDRs of P1-068744_E31S_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E100S;

(gggg) a VH comprising the VH CDRs of the VH of P1-068744_H50I_E100S and a VL comprising the VL CDRs of P1-068744_H50I_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E100S;

(hhhh) a VH comprising the VH CDRs of the VH of P1-068744_H50I_E102Y and a VL comprising the VL CDRs of P1-068744_H50I_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E102Y;

(iiii) a VH comprising the VH CDRs of the VH of P1-068744_E59Y_E102Y and a VL comprising the VL CDRs of P1-068744_E59Y_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E59Y_E102Y;

(jjjj) a VH comprising the VH CDRs of the VH of P1-068748_H31S and a VL comprising the VL CDRs of P1-068748_H31S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H31S;

(kkkk) a VH comprising the VH CDRs of the VH of P1-068748_H32Y and a VL comprising the VL CDRs of P1-068748_H32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H32Y;

(llll) a VH comprising the VH CDRs of the VH of P1-068748_D57K and a VL comprising the VL CDRs of P1-068748_D57K and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D57K;

(mmmm) a VH comprising the VH CDRs of the VH of P1-068748_D58Y and a VL comprising the VL CDR1, CDR2 and CDR3 of P1-068748_D58Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D58Y;

(nnnn) a VH comprising the VH CDRs of the VH of P1-068748_D100S and a VL comprising the VL CDRs of P1-068748_D100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D100S;

(oooo) a VH comprising the VH CDRs of the VH of P1-068748_H31S_H32Y and a VL comprising the VL CDRs of P1-068748_H31S_H32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H31S_H32Y;

(pppp) a VH comprising the VH CDRs of the VH of P1-068748_H32Y_D57K and a VL comprising the VL CDRs of P1-068748_H32Y_D57K and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D57K;

(qqqq) a VH comprising the VH CDRs of the VH of P1-068748_D57K_D58Y and a VL comprising the VL CDRs of P1-068748_D57K_D58Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D57K_D58Y;

(rrrr) a VH comprising the VH CDRs of the VH of P1-068748_D58Y_D100S and a VL comprising the VL CDRs of P1-068748_D58Y_D100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D58Y_D100S;

(ssss) a VH comprising the VH CDRs of the VH of P1-068748_H31S_D57K and a VL comprising the VL CDRs of P1-068748_H31S_D57K and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D57K;

(tttt) a VH comprising the VH CDRs of the VH of P1-068748_H31S_D58Y and a VL comprising the VL CDRs of P1-068748_H31S_D58Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D58Y;

(uuuu) a VH comprising the VH CDRs of the VH of P1-068748_H31S_D100S and a VL comprising the VL CDRs of P1-068748_H31S_D100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D100S;

(vvvv) a VH comprising the VH CDRs of the VH of P1-068748_H32Y_D58Y and a VL comprising the VL CDRs of P1-068748_H32Y_D58Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D58Y;

(wwww) a VH comprising the VH CDRs of the VH of P1-068748_H32Y_D100S and a VL comprising the VL CDRs of P1-068748_H32Y_D100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D100S; or (xxxx) a VH comprising the VH CDRs of the VH of P1-068748_D57K_D100S and a VL comprising the VL CDRs of P1-068748_D57K_D100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_D57K_D100S, optionally wherein the VH in any of (a) or (c)-(ttt) comprises one or both of the K16R and T84A substitutions, or wherein the VL in any of (b) or (uuu)-(xxxx) contains a T85V substitution.

In some of the above embodiments, the VH and/or VL may differ from the sequence of each of the species (a) to (ttt) by the presence of 1, 2, 3, 4, or 5 amino acid substitutions, such as 1, 2, 3, 4, or 5 conservative substitutions. In some embodiments, the VH of P1-061029 or one of its progeny antibodies may comprise one or both of the K16R and T84A substitutions. In some embodiments, the VL of P1-061015 or one of its progeny antibodies may comprise a T85V substitution.

An anti-h VISTA Ab may comprise:

(a) a VH consisting of the amino acid sequence of the VH of P1-061029 and a VL consisting of the VL of P1-061029;

(b) a VH consisting of the amino acid sequence of the VH of P1-061015 and a VL consisting of the VL of P1-061015;

(c) a VH consisting of the amino acid sequence of the VH of P1-068757 and a VL consisting of the VL of P1-068757;

(d) a VH consisting of the amino acid sequence of the VH of P1-068759 and a VL consisting of the VL of P1-068759;

(e) a VH consisting of the amino acid sequence of the VH of P1-068761 and a VL consisting of the VL of P1-068761;

(f) a VH consisting of the amino acid sequence of the VH of P1-068763 and a VL consisting of the VL of P1-068763;

(g) a VH consisting of the amino acid sequence of the VH of P1-068765 and a VL consisting of the VL of P1-068765;

(h) a VH consisting of the amino acid sequence of the VH of P1-068767 and a VL consisting of the VL of P1-068767;

(i) a VH consisting of the amino acid sequence of the VH of P1-068769 and a VL consisting of the VL of P1-068769;

(j) a VH consisting of the amino acid sequence of the VH of P1-068771 and a VL consisting of the VL of P1-068771;

(k) a VH consisting of the amino acid sequence of the VH of P1-068773 and a VL consisting of the VL of P1-068773;

(l) a VH consisting of the amino acid sequence of the VH of P1-068775 and a VL consisting of the VL of P1-068775;

(m) a VH consisting of the amino acid sequence of the VH of P1-069059 and a VL consisting of the VL of P1-069059;

(n) a VH consisting of the amino acid sequence of the VH of P1-069061 and a VL consisting of the VL of P1-069061;

(o) a VH consisting of the amino acid sequence of the VH of P1-069063 and a VL consisting of the VL of P1-069063;

(p) a VH consisting of the amino acid sequence of the VH of P1-069065 and a VL consisting of the VL of P1-069065;

(q) a VH consisting of the amino acid sequence of the VH of P1-069067 and a VL consisting of the VL of P1-069067;

(r) a VH consisting of the amino acid sequence of the VH of P1-069069 and a VL consisting of the VL of P1-069069;

(s) a VH consisting of the amino acid sequence of the VH of P1-069071 and a VL consisting of the VL of P1-069071;

(t) a VH consisting of the amino acid sequence of the VH of P1-069073 and a VL consisting of the VL of P1-069073;

(u) a VH consisting of the amino acid sequence of the VH of P1-069075 and a VL consisting of the VL of P1-069075;

(v) a VH consisting of the amino acid sequence of the VH of P1-069077 and a VL consisting of the VL of P1-069077;

(w) a VH consisting of the amino acid sequence of the VH of P1-068736 and a VL consisting of the VL of P1-068736;

(x) a VH consisting of the amino acid sequence of the VH of P1-068738 and a VL consisting of the VL of P1-068738;

(y) a VH consisting of the amino acid sequence of the VH of P1-068740 and a VL consisting of the VL of P1-068740;

(z) a VH consisting of the amino acid sequence of the VH of P1-068742 and a VL consisting of the VL of P1-068742;
(aa) a VH consisting of the amino acid sequence of the VH of P1-068744 and a VL consisting of the VL of P1-068744;
(bb) a VH consisting of the amino acid sequence of the VH f P1-068746 and a VL consisting of the VL of P1-068746;
(cc) a VH consisting of the amino acid sequence of the VH of P1-068748 and a VL consisting of the VL of P1-068748;
(dd) a VH consisting of the amino acid sequence of the VH of P1-068750 and a VL consisting of the VL of P1-068750;
(ee) a VH consisting of the amino acid sequence of the VH of P1-068752 and a VL consisting of the VL of P1-068752;
(ff) a VH consisting of the amino acid sequence of the VH of P1-068754 and a VL consisting of the VL of P1-068754;
(gg) a VH consisting of the amino acid sequence of the VH of P1-068761_E55A and a VL consisting of the amino acid sequence of the VL of P1-068761_E55A;
(hh) a VH consisting of the amino acid sequence of the VH of P1-068761_H100G and a VL consisting of the amino acid sequence of the VL of P1-068761_H100G;
(ii) a VH consisting of the amino acid sequence of the VH of P1-068761_E56N and a VL consisting of the amino acid sequence of the VL of P1-068761_E56N;
(jj) a VH consisting of the amino acid sequence of the VH of P1-068761_E55A_E56N and a VL consisting of the amino acid sequence of the VL of P1-068761_E55A_E56N;
(kk) a VH consisting of the amino acid sequence of the VH of P1-068761_E30D and a VL consisting of the amino acid sequence of the VL of P1-068761_E30D;
(ll) a VH consisting of the amino acid sequence of the VH of P1-068761_E30D_E55A and a VL consisting of the amino acid sequence of the VL of P1-068761_E30D_E55A;
(mm) a VH consisting of the amino acid sequence of the VH of P1-068761_E56N_H100G and a VL consisting of the amino acid sequence of the VL of P1-068761_E56N_H100G;
(nn) a VH consisting of the amino acid sequence of the VH of P1-068761_E30D_H100G and a VL consisting of the amino acid sequence of the VL of P1-068761_E30D_H100G;
(oo) a VH consisting of the amino acid sequence of the VH of P1-068761_E30D_E56N and a VL consisting of the amino acid sequence of the VL of P1-068761_E30D_E56N;
(pp) a VH consisting of the amino acid sequence of the VH of P1-068761_E100fF and a VL consisting of the amino acid sequence of the VL of P1-068761_E100fF;
(qq) a VH consisting of the amino acid sequence of the VH of P1-068761_E55A_E100fF and a VL consisting of the amino acid sequence of the VL of P1-068761_E55A_E100fF;
(rr) a VH consisting of the amino acid sequence of the VH of P1-068761_H100G_E100fF and a VL consisting of the amino acid sequence of the VL of P1-068761_H100G_E100fF;
(ss) a VH consisting of the amino acid sequence of the VH of P1-068761_E30D_E100fF and a VL consisting of the amino acid sequence of the VL of P1-068761_E30D_E100fF;
(tt) a VH consisting of the amino acid sequence of the VH of P1-068761_E56N_E100fF and a VL consisting of the amino acid sequence of the VL of P1-068761_E56N_E100fF;
(uu) a VH consisting of the amino acid sequence of the VH of P1-068761_E32Y and a VL consisting of the amino acid sequence of the VL of P1-068761_E32Y;
(vv) a VH consisting of the amino acid sequence of the VH of P1-068761_E32Y_E55A and a VL consisting of the amino acid sequence of the VL of P1-068761_E32Y_E55A;
(ww) a VH consisting of the amino acid sequence of the VH of P1-068761_E32Y_E56N and a VL consisting of the amino acid sequence of the VL of P1-068761_E32Y_E56N;
(xx) a VH consisting of the amino acid sequence of the VH of P1-068761_E30D_E32Y and a VL consisting of the amino acid sequence of the VL of P1-068761_E30D_E32Y;
(yy) a VH consisting of the amino acid sequence of the VH of P1-068761_E32Y_H100G and a VL consisting of the amino acid sequence of the VL of P1-068761_E32Y_H100G;
(zz) a VH consisting of the amino acid sequence of the VH of P1-068761_E32Y_E100fF and a VL consisting of the amino acid sequence of the VL of P1-068761_E32Y_E100fF;
(aaa) a VH consisting of the amino acid sequence of the VH of P1-068767_D52N_D102V and a VL consisting of the amino acid sequence of the VL of P1-068767_D52N_D102V;
(bbb) a VH consisting of the amino acid sequence of the VH of P1-068767_D52N and a VL consisting of the amino acid sequence of the VL of P1-068767_D52N;
(ccc) a VH consisting of the amino acid sequence of the VH of P1-068767_D52N_E55A and a VL consisting of the amino acid sequence of the VL of P1-068767_D52N_E55A;
(ddd) a VH consisting of the amino acid sequence of the VH of P1-068767_E55A_D102V and a VL consisting of the amino acid sequence of the VL of P1-068767_E55A_D102V;
(eee) a VH consisting of the amino acid sequence of the VH of P1-068767_D102V and a VL consisting of the amino acid sequence of the VL of P1-068767_D102V;
(fff) a VH consisting of the amino acid sequence of the VH of P1-068767_E55A and a VL consisting of the amino acid sequence of the VL of P1-068767_E55A;
(ggg) a VH consisting of the amino acid sequence of the VH of P1-068767_E30D_D52N and a VL consisting of the amino acid sequence of the VL of P1-068767_E30D_D52N;
(hhh) a VH consisting of the amino acid sequence of the VH of P1-068767_E30D_D102V and a VL consisting of the amino acid sequence of the VL of P1-068767_E30D_D102V;
(iii) a VH consisting of the amino acid sequence of the VH of P1-068767_E30D and a VL consisting of the amino acid sequence of the VL of P1-068767_E30D;
(jjj) a VH consisting of the amino acid sequence of the VH of P1-068767_E30D_E55A and a VL consisting of the amino acid sequence of the VL of P1-068767_E30D_E55A;
(kkk) a VH consisting of the amino acid sequence of the VH of P1-068767_E100fF_D102V and a VL consisting of the amino acid sequence of the VL of P1-068767_E100fF_D102V;

(lll) a VH consisting of the amino acid sequence of the VH of P1-068767_E55A_E100fF and a VL consisting of the amino acid sequence of the VL of P1-068767_E55A_E100fF;

(mmm) a VH consisting of the amino acid sequence of the VH of P1-068767_D52N_E100fF and a VL consisting of the amino acid sequence of the VL of P1-068767_D52N_E100fF;

(nnn) a VH consisting of the amino acid sequence of the VH of P1-068767_E100fF and a VL consisting of the amino acid sequence of the VL of P1-068767_E100fF;

(ooo) a VH consisting of the amino acid sequence of the VH of P1-068767_E30D_E100fF and a VL consisting of the amino acid sequence of the VL of P1-068767_E30D_E100fF;

(ppp) a VH consisting of the amino acid sequence of the VH of P1-061029_F100fE_V102D and a VL consisting of the amino acid sequence of the VL of P1-061029_F100fE_V102D;

(qqq) a VH consisting of the amino acid sequence of the VH of P1-061029_F100fE and a VL consisting of the amino acid sequence of the VL of P1-061029_F100fE;

(rrr) a VH consisting of the amino acid sequence of the VH of P1-061029_V102D and a VL consisting of the amino acid sequence of the VL of P1-061029_V102D;

(sss) a VH consisting of the amino acid sequence of the VH of P1-061029_Y32E and a VL consisting of the amino acid sequence of the VL of P1-061029_Y32E;

(ttt a VH consisting of the amino acid sequence of the VH of P1-061029_Y32E_F100fE and a VL consisting of the amino acid sequence of the VL of P1-061029_Y32E_F100fE;

(uuu) a VH consisting of the amino acid sequence of the VH of P1-068744_E31S and a VL consisting of the amino acid sequence of the VL of P1-068744_E31S;

(vvv) a VH consisting of the amino acid sequence of the VH of P1-068744_H50I and a VL consisting of the amino acid sequence of the VL of P1-068744_H50I;

(www) a VH consisting of the amino acid sequence of the VH of P1-068744_E59Y and a VL consisting of the amino acid sequence of the VL of P1-068744_E59Y;

(xxx) a VH consisting of the amino acid sequence of the VH of P1-068744_E100S and a VL consisting of the amino acid sequence of the VL of P1-068744_E100S;

(yyy) a VH consisting of the amino acid sequence of the VH of P1-068744_E102Y and a VL consisting of the amino acid sequence of the VL of P1-068744_E102Y;

(zzz) a VH consisting of the amino acid sequence of the VH of P1-068744_E31S_H50I and a VL comprising the VL of P1-068744_E31S_H50I;

(aaaa) a VH comprising the amino acid sequence of the VH of P1-068744_H50I_E59Y and a VL consisting of the amino acid sequence of the VL of P1-068744_H50I_E59Y;

(bbbb) a VH consisting of the amino acid sequence of the VH of P1-068744_E59Y_E100S and a VL consisting of the amino acid sequence of the VL of P1-068744_E5;9Y_E100S;

(cccc) a VH consisting of the amino acid sequence of the VH of P1-068744_E100S_E102Y and a VL consisting of the amino acid sequence of the VL of P1-068744_E100S_E102Y;

(dddd) a VH consisting of the amino acid sequence of the VH of P1-068744_E31S_E102Y and a VL consisting of the amino acid sequence of the VL of P1-068744_E31S_E102Y;

(eeee) a VH consisting of the amino acid sequence of the VH of P1-068744_E31S_E59Y and a VL consisting of the amino acid sequence of the VL of P1-068744_E31S_E59Y;

(ffff) a VH consisting of the amino acid sequence of the VH of P1-068744_E31S_E100S and a VL consisting of the amino acid sequence of the VL of P1-068744_E31S_E100S;

(gggg) a VH consisting of the amino acid sequence of the VH of P1-068744_H50I_E100S and a VL consisting of the amino acid sequence of the VL of P1-068744_H50I_E100S;

(hhhh) a VH consisting of the amino acid sequence of the VH of P1-068744_H50I_E102Y and a VL consisting of the amino acid sequence of the VL of P1-068744_H50I_E102Y;

(iiii) a VH consisting of the amino acid sequence of the VH of P1-068744_E59Y_E102Y and a VL consisting of the amino acid sequence of the VL of P1-068744_E59Y_E102Y;

(jjjj) a VH consisting of the amino acid sequence of the VH of P1-068748_H31S and a VL consisting of the amino acid sequence of the VL of P1-068748_H31S;

(kkkk) a VH consisting of the amino acid sequence of the VH of P1-068748_H32Y and a VL consisting of the amino acid sequence of the VL of P1-068748_H32Y;

(llll) a VH consisting of the amino acid sequence of the VH of P1-068748_D57K and a VL consisting of the amino acid sequence of the VL of P1-068748_D57K;

(mmmm) a VH consisting of the amino acid sequence of the VH of P1-068748_D58Y and a VL consisting of the amino acid sequence of the VL of P1-068748_D58Y;

(nnnn) a VH consisting of the amino acid sequence of the VH of P1-068748_D100S and a VL consisting of the amino acid sequence of the VL of P1-068748_D100S;

(oooo) a VH consisting of the amino acid sequence of the VH of P1-068748_H31S_H32Y and a VL consisting of the amino acid sequence of the VL of P1-068748_H31S_H32Y;

(pppp) a VH consisting of the amino acid sequence of the VH of P1-068748_H32Y_D57K and a VL consisting of the amino acid sequence of the VL of P1-068748_H32Y_D57K;

(qqqq) a VH consisting of the amino acid sequence of the VH of P1-068748_D57K_D58Y and a VL consisting of the amino acid sequence of the VL of P1-068748_D57K_D58Y;

(rrrr) a VH consisting of the amino acid sequence of the VH of P1-068748_D58Y_D100S and a VL consisting of the amino acid sequence of the VL of P1-068748_D58Y_D100S;

(ssss) a VH consisting of the amino acid sequence of the VH of P1-068748_H31S_D57K and a VL consisting of the amino acid sequence of the VL of P1-068748_H31S_D57K;

(tttt) a VH consisting of the amino acid sequence of the VH of P1-068748_H31S_D58Y and a VL consisting of the amino acid sequence of the VL of P1-068748_H31S_D58Y;

(uuuu) a VH consisting of the amino acid sequence of the VH of P1-068748_H31S_D100S and a VL consisting of the amino acid sequence of the VL of P1-068748_H31S_D100S;

(vvvv) a VH consisting of the amino acid sequence of the VH of P1-068748_H32Y_D58Y and a VL consisting of the amino acid sequence of the VL of P1-068748_H32Y_D58Y;

(wwww) a VH consisting of the amino acid sequence of the VH of P1-068748_H32Y_D100S and a VL consisting of the amino acid sequence of the VL of P1-068748_H32Y_D100S; or (xxxx) a VH consisting of the amino acid sequence of the VH of P1-068748_D57K_D100S and a VL consisting of the amino acid sequence of the VL of P1-068748_D57K_D100S, optionally wherein the VH in any of (a) or (c)-(ttt) comprises one or both of the heavy chain K16R and T84A substitutions, and optionally wherein the VL in any of (b) or (uuu)-(xxxx) comprises a T85V substitution.

In certain embodiments, an anti-VISTA Ab comprises any of the variable regions and/or variable region CDRs 1-3 of the antibodies described above and elsewhere herein, such as:

(1) one or more of VH CDR1, CDR2 and CDR3 of:
(2) the VH CDR1, CDR2 and CDR3 of:
(3) the VH of:
(4) one or more of VH CDR1, CDR2 and CDR3 and one or more of VL CDR1, CDR2 and CDR3 of:
(5) the VH CDR1, CDR2 and CDR3 and VL CDR1, CDR2 and CDR3 of:
(6) the VH and the VLs of:
or
(7) the VL (optionally, with the exception of the T85V substitution in the VL of P1-061015 or its progeny) and the VH, (optionally, with the exception of one or both of K16R and T84A substitutions in the VH in the case of P1-061029 or its progeny), of:

P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S; and the anti-VISTA Ab is also an IgG antibody, such as IgG1, IgG2, IgG3 or IgG4 antibody or a modified form thereof as described in the section below. In some embodiments, the constant region has effector function, and in some embodiments, the constant region is effectorless. In certain embodiments, the constant region is that of IgG1.3.

In certain embodiments, an anti-VISTA Ab comprises any of the variable regions and/or variable region CDRs 1-3 of the antibodies described above and elsewhere herein, such as:

(1) one or more of VH CDR1, CDR2 and CDR3 of:
(2) the VH CDR1, CDR2 and CDR3 of:
(3) the VH of:
(4) one or more of VH CDR1, CDR2 and CDR3 and one or more of VL CDR1, CDR2 and CDR3 of:
(5) the VH CDR1, CDR2 and CDR3 and VL CDR1, CDR2 and CDR3 of:
(6) the VH and the VLs of:
or
(7) the VL and the VH, with the exception of one or both of K16R and T84A substitutions in the VH (in the case of P1-061029 and it progeny), of:

P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S,

P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, and further comprises one or more of the following characteristics:

- specifically binding to hVISTA, e.g., histidine rich region of the ECD or a polypeptide comprising amino acid residues 35-127 of SEQ ID NO: 2, at acidic pH, e.g., pH 6.0 or pH 6.5;
- lacking of significant binding to hVISTA, e.g., histidine rich region of the ECD or a polypeptide comprising amino acid residues 35-127 of SEQ ID NO: 2, at physiological pH or neutral pH, e.g., pH 7.4 or pH 7.0;
- specifically binding to cyno VISTA, e.g., histidine rich region of the ECD, at acidic pH, e.g., pH 6.0 or pH 6.5;
- lacking of significant binding to cyno VISTA, e.g., histidine rich region of the ECD, at physiological pH or neutral pH, e.g., pH 7.4 or pH 7.0;
- having reduced binding to hVISTA-ECD having a substitution at one or more of the following amino acids: T35, Y37, K38, T39, Y41, R54, T61, F62, Q63, L65, H66, L67, H68, H69, F97, L115, V117, I119, H121, H122, S124, E125, R127 relative to hVISTA ECD having SEQ ID NO: 2;
- cross-competing for binding to h VISTA with P1-061029, P1-068761, P1-068767, P1-061015, P1-068744, and/or P1-068748;
- inhibiting binding of hVISTA to human T cells expressing VISTA (e.g., naïve or activated T cells) at acidic pH e.g., pH 6.0 or pH 6.5;
- inhibiting binding of hVISTA to PSGL-1 at acidic pH e.g., pH 6.0 or pH 6.5 (e.g., inhibiting the interaction between H153 and H154 of hVISTA having SEQ ID NO: 1 and PSGL-1 tyrosines Y46 and Y48), wherein PSGL-1 is with or without siayl lewis X, and wherein the tyrosines are preferably sulfotyrosines;
- inhibiting binding of hVISTA to VSIG-3;
- a mean residence time (MRT) of at least 100, 200, 300, 350, 400, 450, 500, 600 or 700 hours (e.g., at least 350 hours) in cynomolgus monkeys, measured, e.g, as described in the Examples;
- stimulating T cell activation by, e.g., enhancing T cell proliferation; enhancing IFN-γ production from T cells; and/or stimulating T cell receptor mediated NF-kB signaling;
- inhibiting VISTA mediated cell: cell adhesion;
- specifically binding to hVISTA in samples of human tumor cells or samples of inflamed human tissue that express VISTA;
- contacting hVISTA through one or more (e.g., at least 1-3, 1-5, 1-10, 5-10, 5-15 or all) energetically important contact residues Y37, T39, R54, F62, H66, V117, I119 or S124 (see Table 21), as determined, e.g., using the yeast surface display and NGS assay described in the Examples; and wherein numbering is that of mature hVISTA (see SEQ ID NO: 2);
- binding to Region 1: $_{57}$LGPVDKGHDVTF$_{68}$ (SEQ ID NO: 566); Region 2: $_{86}$RRPIRNLTFQDL$_{97}$ (SEQ ID NO: 567); and Region 3: $_{148}$VVEIRHHHSEHRVHGAME$_{165}$ (SEQ ID NO: 568) of hVISTA having SEQ ID NO: 1, and optionally wherein the binding is strongest to Region 2, as determined by MS-HDX as described in the Examples;
- binding to the histidine-rich β-sheet extension of hVISTA, as determined, e.g., by crystallography, as described, e.g., in the Examples;
- contacting H121, H122 and/or H123 of mature hVISTA (distance of 4.0 Ångströms (Å) or less), such as through hydrogen bonds, as determined, e.g., by crystallography, as described, e.g., in the Examples;
- contacting hVISTA through at least one or more glutamic acid, aspartic acid or histidine residue that is located in VH CDR1, CDR2 or CDR3;
- accumulates preferably in tumor tissues in human VISTA knock-in mice harboring MC38 tumors in comparison to myeloid cells, in comparison to blood, and/or in comparison to liver, lung and spleen cells, as described in the Examples;
- accumulates preferably in tumors of patients in comparison to myeloid cells, in comparison to blood, and/or in comparison to liver, lung and spleen cells (e.g. detected for example by administering Ab labeled with a PET tracer);
- specifically binding to hVISTA under acidic conditions (e.g. at a pH of 6.5 with a $K_D$ (and/or koff) that is at least 10 fold, 100 fold, or 1000 fold lower than its $K_D$ or koff of binding to hVISTA under neutral or physiological pH as determined by surface plasmon resonance (SPR) as described in Example 30 herein;
- inhibits binding of hVISTA to a cell to which hVISTA binds (e.g. a cell expressing PSGL-1), wherein binding is determined according to the protocol described in Example 31 herein (optionally wherein the cell is a human leukocyte, PBMC, or T cell);
- blocks or cross-blocks binding of any one of the antibodies described herein as determined using competitive SPR epitope binning as described in Example 32 herein; and
- any additional characteristic set forth in the claims and/or in the Examples.

In certain embodiments, an anti-hVISTA Ab comprises a heavy chain (HC) comprising the amino acid sequence of the heavy chain of any of the anti-h VISTA Abs provided herein. In certain embodiments, an anti-hVISTA Ab comprises a heavy chain comprising the amino acid sequence of the heavy chain of P1-061029 or P1-061015 or progeny thereof, as shown below in the Sequence Table, comprising an IgG1.3 heavy chain constant region, such as P1-061029.IgG1.3 (SEQ ID NO: 69), P1-068757.IgG1.3, P1-068759.IgG1.3, P1-068761.IgG1.3, P1-068763.IgG1.3, P1-068765.IgG1.3, P1-068767.IgG1.3, P1-068769.IgG1.3, P1-068771.IgG1.3, P1-068773.IgG1.3, P1-068775.IgG1.3, P1-069059.IgG1.3, P1-069061.IgG1.3, P1-069063.IgG1.3, P1-069065.IgG1.3, P1-069067.IgG1.3, P1-069069.IgG1.3, P1-069071.IgG1.3, P1-069073.IgG1.3, P1-069075.IgG1.3, P1-069077.IgG1.3, P1-061015.IgG1.3, P1-068736.IgG1.3, P1-068738.IgG1.3, P1-068740.IgG1.3, P1-068742.IgG1.3, P1-068744.IgG1.3, P1-068766.IgG1.3, P1-068748.IgG1.3, P1-068750.IgG1.3, P1-068752.IgG1.3, P1-068754.IgG1.3, P1-068761_E55A.IgG1.3, P1-068761_H100G.IgG1.3, P1-068761_E56N.IgG1.3, P1-068761_E55A_E56N.IgG1.3, P1-068761_E30D.IgG1.3, P1-068761_E30D_E55A.IgG1.3, P1-068761_E56N_H100G.IgG1.3, P1-068761_E30D_H100G.IgG1.3, P1-068761_E30D_E56N.IgG1.3, P1-068761_E100fF.IgG1.3, P1-068761_E55A_E100fF.IgG1.3, P1-068761_H100G_E100fF.IgG1.3, P1-068761_E30D_E100fF.IgG1.3, P1-068761_E56N_E100fF.IgG1.3, P1-068761_E32Y.IgG1.3, P1-068761_E32Y_E55A.IgG1.3, P1-068761_E32Y_E56N.IgG1.3, P1-068761_E30D_E32Y.IgG1.3, P1-068761_E32Y_H100G.IgG1.3, P1-068761_E32Y_E100fF.IgG1.3, P1-068767_D52N_D102V.IgG1.3, P1-068767_D52N.IgG1.3, P1-068767_D52N_E55A.IgG1.3, P1-068767_E55A_D102V.IgG1.3, P1-068767_D102V.IgG1.3, P1-068767_E55A.IgG1.3, P1-068767_E30D_D52N.IgG1.3, P1-068767_E30D_D102V.IgG1.3, P1-068767_E30D.IgG1.3, P1-068767_E30D_E55A.IgG1.3, P1-068767_E100fF_D102V.IgG1.3, P1-068767_E55A_E100fF.IgG1.3, P1-068767_D52N_E100fF.IgG1.3, P1-068767_E100fF.IgG1.3, P1-068767_E30D_E100fF.IgG1.3, P1-061029_F100fE_V102D.IgG1.3, P1-061029_F100fE.IgG1.3, P1-061029_V102D.IgG1.3, P1-061029_Y32E.IgG1.3, P1-061029_Y32E_F100fE.IgG1.3, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, and optionally, for the P1-061029 progeny, wherein the VH comprise one or both of the K16R and T84A substitutions, and for the P1-061015 progeny, wherein the VL sequence comprises a T85V substitution.

In certain embodiments, an anti-hVISTA Ab comprises a heavy chain comprising the amino acid sequence of the heavy chain of any of the anti-hVISTA Abs provided herein, which comprise an IgG1.3 heavy chain constant region, and the amino acid sequence of the light chain of any of the anti-hVISTA Abs provided herein. In certain embodiments, an anti-hVISTA Ab comprises a heavy chain comprising the amino acid sequence of the VH of P1-061029 or P1-061015 or progeny thereof, which comprise an IgG1.3 HC constant region, such as P1-061029.IgG1.3 (SEQ ID NO: 69), P1-068757.IgG1.3, P1-068759.IgG1.3, P1-068761.IgG1.3, P1-068763.IgG1.3, P1-068765.IgG1.3, P1-068767.IgG1.3, P1-068769.IgG1.3, P1-068771.IgG1.3, P1-068773.IgG1.3, P1-068775.IgG1.3, P1-069059.IgG1.3, P1-069061.IgG1.3, P1-069063.IgG1.3, P1-069065.IgG1.3, P1-069067.IgG1.3, P1-069069.IgG1.3, P1-069071.IgG1.3, P1-069073.IgG1.3, P1-069075.IgG1.3, P1-069077.IgG1.3, P1-061015.IgG1.3, P1-068736.IgG1.3, P1-068738.IgG1.3, P1-068740.IgG1.3, P1-068742.IgG1.3, P1-068744.IgG1.3, P1-068766.IgG1.3, P1-068748.IgG1.3, P1-068750.IgG1.3, P1-068752.IgG1.3, P1-068754.IgG1.3, P1-068761_E55A.IgG1.3, P1-068761_H100G.IgG1.3, P1-068761_E56N.IgG1.3, P1-068761_E55A_E56N.IgG1.3, P1-068761_E30D.IgG1.3, P1-068761_E30D_E55A.IgG1.3, P1-068761_E56N_H100G.IgG1.3, P1-068761_E30D_H100G.IgG1.3, P1-068761_E30D_E56N.IgG1.3, P1-068761_E100fF.IgG1.3, P1-068761_E55A_E100fF.IgG1.3, P1-068761_H100G_E100fF.IgG1.3, P1-068761_E30D_E100fF.IgG1.3, P1-068761_E56N_E100fF.IgG1.3, P1-068761_E32Y.IgG1.3, P1-068761_E32Y_E55A.IgG1.3, P1-068761_E32Y_E56N.IgG1.3, P1-068761_E30D_E32Y.IgG1.3, P1-068761_E32Y_H100G.IgG1.3, P1-068761_E32Y_E100fF.IgG1.3, P1-068767_D52N_D102V.IgG1.3, P1-068767_D52N.IgG1.3, P1-068767_D52N_E55A.IgG1.3, P1-068767_E55A_D102V.IgG1.3, P1-068767_D102V.IgG1.3, P1-068767_E55A.IgG1.3, P1-068767_E30D_D52N.IgG1.3, P1-068767_E30D_D102V.IgG1.3, P1-068767_E30D.IgG1.3, P1-068767_E30D_E55A.IgG1.3, P1-068767_E100fF_D102V.IgG1.3, P1-068767_E55A_E100fF.IgG1.3, P1-068767_D52N_E100fF.IgG1.3, P1-068767_E100fF.IgG1.3, P1-068767_E30D_E100fF.IgG1.3, P1-061029_F100fE_V102D.IgG1.3, P1-061029_F100fE.IgG1.3, P1-061029_V102D.IgG1.3, P1-061029_Y32E.IgG1.3, P1-061029_Y32E_F100fE.IgG1.3, P1-068744_E31S.IgG1.3, P1-68744_H50I.IgG1.3, P1-68744_E59Y.IgG1.3, P1-068744_E100S.IgG1.3, P1-068744_E102Y.IgG1.3, P1-068744_E31S_H50I.IgG1.3, P1-068744_H50I_E59Y.IgG1.3, P1-068744_E59Y_E100S.IgG1.3, P1-068744_E100S_E102Y.IgG1.3, P1-068744_E31S_E102Y.IgG1.3, P1-068744_E31S_E59Y.IgG1.3, P1-068744_E31S_E100S.IgG1.3, P1-068744_H50I_E100S.IgG1.3, P1-068744_H50I_E102Y.IgG1.3, P1-068744_E59Y_E102Y.IgG1.3, P1-068748_H31S, P1-068748_H32Y.IgG1.3, P1-068748_D57K.IgG1.3, P1-068748_D58Y.IgG1.3, P1-068748_D100S.IgG1.3, P1-068748_H31S_H32Y.IgG1.3, P1-068748_H32Y_D57K.IgG1.3, P1-068748_D57K_D58Y.IgG1.3, P1-068748_D58Y_D100S.IgG1.3, P1-068748_H31S_D57K.IgG1.3, P1-068748_H31S_D58Y.IgG1.3, P1-068748_H31S_D100S.IgG1.3, P1-068748_H32Y_D58Y.IgG1.3, P1-068748_H32Y_D100S.IgG1.3, or P1-068748_D57K_D100S.IgG1.3, and optionally, for the P1-061029 progeny, wherein the VH comprise one or both of the K16R and T84A substitutions; and a light chain comprising the amino acid sequence of the light chain of P1-061029 or P1-061015, and optionally, for the P1-061015 progeny, wherein the VL sequence comprises a T85V substitution.

An anti-h VISTA Ab may comprise:

(a) a heavy chain comprising the amino acid sequence of the heavy chain of P1-061029.IgG1.3 (SEQ ID NO: 69) and a light chain comprising the light chain amino acid sequence of P1-061029 (SEQ ID NO: 70);

(b) a heavy chain comprising the amino acid sequence of the heavy chain of P1-061015.IgG1.3 and a light chain comprising the light chain amino acid sequence of P1-061015;

(c) a heavy chain comprising the amino acid sequence of the heavy chain of P1-068757.IgG1.3 and a light chain comprising the light chain amino acid sequence of P1-068757;

(d) a heavy chain comprising the amino acid sequence of the heavy chain of P1-068759.IgG1.3 and a light chain comprising the light chain amino acid sequence of P1-068759;

(e) a heavy chain comprising the amino acid sequence of the heavy chain of P1-068761.IgG1.3 and a light chain comprising the light chain amino acid sequence of P1-068761;

(f) a heavy chain comprising the amino acid sequence of the heavy chain of P1-068763.IgG1.3 and a light chain comprising the light chain amino acid sequence of P1-068763;

(g) a heavy chain comprising the amino acid sequence of the heavy chain of P1-068765.IgG1.3 and a light chain comprising the light chain amino acid sequence of P1-068765;

(h) a heavy chain comprising the amino acid sequence of the heavy chain of P1-068767.IgG1.3 and a light chain comprising the light chain amino acid sequence of P1-068767;

(i) a heavy chain comprising the amino acid sequence of the heavy chain of P1-068769.IgG1.3 and a light chain comprising the light chain amino acid sequence of P1-068769;

(j) a heavy chain comprising the amino acid sequence of the heavy chain of P1-068771.IgG1.3 and a light chain comprising the light chain amino acid sequence of P1-068771;

(k) a heavy chain comprising the amino acid sequence of the heavy chain of P1-068773.IgG1.3 and a light chain comprising the light chain amino acid sequence of P1-068773;

(l) a heavy chain comprising the amino acid sequence of the heavy chain of P1-068775.IgG1.3 and a light chain comprising the light chain amino acid sequence of P1-068775;

(m) a heavy chain comprising the amino acid sequence of the heavy chain of P1-069059.IgG1.3 and a light chain comprising the light chain amino acid sequence of P1-069059;

(n) a heavy chain comprising the amino acid sequence of the heavy chain of P1-069061.IgG1.3 and a light chain comprising the light chain amino acid sequence of P1-069061;

(o) a heavy chain comprising the amino acid sequence of the heavy chain of P1-069063.IgG1.3 and a light chain comprising the light chain amino acid sequence of P1-069063;

(p) a heavy chain comprising the amino acid sequence of the heavy chain of P1-069065.IgG1.3 and a light chain comprising the light chain amino acid sequence of P1-069065;

(q) a heavy chain comprising the amino acid sequence of the heavy chain of P1-069067.IgG1.3 and a light chain comprising the light chain amino acid sequence of P1-069067;

(r) a heavy chain comprising the amino acid sequence of the heavy chain of P1-069069.IgG1.3 and a light chain comprising the light chain amino acid sequence of P1-069069;

(s) a heavy chain comprising the amino acid sequence of the heavy chain of P1-069071.IgG1.3 and a light chain comprising the light chain amino acid sequence of P1-069071;

(t) a heavy chain comprising the amino acid sequence of the heavy chain of P1-069073.IgG1.3 and a light chain comprising the light chain amino acid sequence of P1-069073;

(u) a heavy chain comprising the amino acid sequence of the heavy chain of P1-069075.IgG1.3 and a light chain comprising the light chain amino acid sequence of P1-069075;

(v) a heavy chain comprising the amino acid sequence of the heavy chain of P1-069077.IgG1.3 and a light chain comprising the light chain amino acid sequence of P1-069077;

(w) a heavy chain comprising the amino acid sequence of the heavy chain of P1-068736.IgG1.3 and a light chain comprising the light chain amino acid sequence of P1-068736;

(x) a heavy chain comprising the amino acid sequence of the heavy chain of P1-068738.IgG1.3 and a light chain comprising the light chain amino acid sequence of P1-068738;

(y) a heavy chain comprising the amino acid sequence of the heavy chain of P1-068740.IgG1.3 and a light chain comprising the light chain amino acid sequence of P1-068740;

(z) a heavy chain comprising the amino acid sequence of the heavy chain of P1-068742.IgG1.3 and a light chain comprising the light chain amino acid sequence of P1-068742;

(aa) a heavy chain comprising the amino acid sequence of the heavy chain of P1-068744.IgG1.3 and a light chain comprising the light chain amino acid sequence of P1-068744;

(bb) a heavy chain comprising the amino acid sequence of the heavy chain f P1-068746.IgG1.3 and a light chain comprising the light chain amino acid sequence of P1-068746;

(cc) a heavy chain comprising the amino acid sequence of the heavy chain of P1-068748.IgG1.3 and a light chain comprising the light chain amino acid sequence of P1-068748;

(dd) a heavy chain comprising the amino acid sequence of the heavy chain of P1-068750.IgG1.3 and a light chain comprising the light chain amino acid sequence of P1-068750;

(ee) a heavy chain comprising the amino acid sequence of the heavy chain of P1-068752.IgG1.3 and a light chain comprising the light chain amino acid sequence of P1-068752;

(ff) a heavy chain comprising the amino acid sequence of the heavy chain of P1-068754.IgG1.3 and a light chain comprising the light chain amino acid sequence of P1-068754;

(gg) a heavy chain comprising the amino acid sequence of the heavy chain of P1-068761_E55A.IgG1.3 and a light chain comprising the light chain amino acid sequence of P1-068761_E55A;

(hh) a heavy chain comprising the amino acid sequence of the heavy chain of P1-068761_H100G.IgG1.3 and a light chain comprising the light chain amino acid sequence of P1-068761_H100G;

(ii) a heavy chain comprising the amino acid sequence of the heavy chain of P1-068761_E56N.IgG1.3 and a light chain comprising the light chain amino acid sequence of P1-068761_E56N;

(jj) a heavy chain comprising the amino acid sequence of the heavy chain of P1-068761_E55A_E56N.IgG1.3 and a light chain comprising the light chain amino acid sequence of P1-068761_E55A_E56N;

(kk) a heavy chain comprising the amino acid sequence of the heavy chain of P1-068761_E30D.IgG1.3 and a light chain comprising the light chain amino acid sequence of P1-068761_E30D;

(ll) a heavy chain comprising the amino acid sequence of the heavy chain of P1-068761_E30D_E55A.IgG1.3 and a light chain comprising the light chain amino acid sequence of P1-068761_E30D_E55A;

(mm) a heavy chain comprising the amino acid sequence of the heavy chain of P1-068761_E56N_H100G.IgG1.3 and a light chain comprising the light chain amino acid sequence of P1-068761_E56N_H100G;

(nn) a heavy chain comprising the amino acid sequence of the heavy chain of P1-068761_E30D_H100G.IgG1.3 and a light chain comprising the light chain amino acid sequence of P1-068761_E30D_H100G;

(oo) a heavy chain comprising the amino acid sequence of the heavy chain of P1-068761_E30D_E56N.IgG1.3 and a light chain comprising the light chain amino acid sequence of P1-068761_E30D_E56N;

(pp) a heavy chain comprising the amino acid sequence of the heavy chain of P1-068761_E100fF.IgG1.3 and a light chain comprising the light chain amino acid sequence of P1-068761_E100fF;

(qq) a heavy chain comprising the amino acid sequence of the heavy chain of P1-068761_E55A_E100fF.IgG1.3 and a light chain comprising the light chain amino acid sequence of P1-068761_E55A_E100fF;

(rr) a heavy chain comprising the amino acid sequence of the heavy chain of P1-068761_H100G_E100fF.IgG1.3 and a light chain comprising the light chain amino acid sequence of P1-068761_H100G_E100fF;

(ss) a heavy chain comprising the amino acid sequence of the heavy chain of P1-068761_E30D_E100fF.IgG1.3 and a light chain comprising the light chain amino acid sequence of P1-068761_E30D_E100fF;

(tt) a heavy chain comprising the amino acid sequence of the heavy chain of P1-068761_E56N_E100fF.IgG1.3 and a light chain comprising the light chain amino acid sequence of P1-068761_E56N_E100fF;

(uu) a heavy chain comprising the amino acid sequence of the heavy chain of P1-068761_E32Y.IgG1.3 and a light chain comprising the light chain amino acid sequence of P1-068761_E32Y;

(vv) a heavy chain comprising the amino acid sequence of the heavy chain of P1-068761_E32Y_E55A.IgG1.3 and a light chain comprising the light chain amino acid sequence of P1-068761_E32Y_E55A;

(ww) a heavy chain comprising the amino acid sequence of the heavy chain of P1-068761_E32Y_E56N.IgG1.3 and a light chain comprising the light chain amino acid sequence of P1-068761_E32Y_E56N;

(xx) a heavy chain comprising the amino acid sequence of the heavy chain of P1-068761_E30D_E32Y.IgG1.3 and a light chain comprising the light chain amino acid sequence of P1-068761_E30D_E32Y;

(yy) a heavy chain comprising the amino acid sequence of the heavy chain of P1-068761_E32Y_H100G.IgG1.3 and a light chain comprising the light chain amino acid sequence of P1-068761_E32Y_H100G;

(zz) a heavy chain comprising the amino acid sequence of the heavy chain of P1-068761_E32Y_E100fF.IgG1.3 and a light chain comprising the light chain amino acid sequence of P1-068761_E32Y_E100fF;

(aaa) a heavy chain comprising the amino acid sequence of the heavy chain of P1-068767_D52N_D102V.IgG1.3 and a light chain comprising the light chain amino acid sequence of P1-068767_D52N_D102V;

(bbb) a heavy chain comprising the amino acid sequence of the heavy chain of P1-068767_D52N.IgG1.3 and a light chain comprising the light chain amino acid sequence of P1-068767_D52N;

(ccc) a heavy chain comprising the amino acid sequence of the heavy chain of P1-068767_D52N_E55A.IgG1.3 and a light chain comprising the light chain amino acid sequence of P1-068767_D52N_E55A;

a heavy chain comprising the amino acid sequence of the heavy chain of P1-(ddd) 068767_E55A_D102V.IgG1.3 and a light chain comprising the light chain amino acid sequence of P1-068767_E55A_D102V;

(eee) a heavy chain comprising the amino acid sequence of the heavy chain of P1-068767_D102V.IgG1.3 and a light chain comprising the light chain amino acid sequence of P1-068767_D102V;

(fff) a heavy chain comprising the amino acid sequence of the heavy chain of P1-068767_E55A.IgG1.3 and a light chain comprising the light chain amino acid sequence of P1-068767_E55A;

(ggg) a heavy chain comprising the amino acid sequence of the heavy chain of P1-068767_E30D_D52N.IgG1.3 and a light chain comprising the light chain amino acid sequence of P1-068767_E30D_D52N;

(hhh) a heavy chain comprising the amino acid sequence of the heavy chain of P1-068767_E30D_D102V.IgG1.3 and a light chain comprising the light chain amino acid sequence of P1-068767_E30D_D102V;

(iii) a heavy chain comprising the amino acid sequence of the heavy chain of P1-068767_E30D.IgG1.3 and a light chain comprising the light chain amino acid sequence of P1-068767_E30D;

(jjj) a heavy chain comprising the amino acid sequence of the heavy chain of P1-068767_E30D_E55A.IgG1.3 and a light chain comprising the light chain amino acid sequence of P1-068767_E30D_E55A;

(kkk) a heavy chain comprising the amino acid sequence of the heavy chain of P1-068767_E100fF_D102V.IgG1.3 and a light chain comprising the light chain amino acid sequence of P1-068767_E100fF_D102V;

(lll) a heavy chain comprising the amino acid sequence of the heavy chain of P1-068767_E55A_E100fF.IgG1.3 and a light chain comprising the light chain amino acid sequence of P1-068767_E55A_E100fF;

(mmm) a heavy chain comprising the amino acid sequence of the heavy chain of P1-068767_D52N_E100fF.IgG1.3 and a light chain comprising the light chain amino acid sequence of P1-068767_D52N_E100fF;

(nnn) a heavy chain comprising the amino acid sequence of the heavy chain of P1-068767_E100fF.IgG1.3 and a light chain comprising the light chain amino acid sequence of P1-068767_E100fF;

(ooo) a heavy chain comprising the amino acid sequence of the heavy chain of P1-068767_E30D_E100fF.IgG1.3 and a light chain comprising the light chain amino acid sequence of P1-068767_E30D_E100fF.

(ppp) a heavy chain comprising the amino acid sequence of the heavy chain of P1-061029_F100fE_V102D.IgG1.3 and a light chain comprising the light chain amino acid sequence of P1-061029_F100fE_V102D;

(qqq) a heavy chain comprising the amino acid sequence of the heavy chain of P1-061029_F100fE.IgG1.3 and a light chain comprising the light chain amino acid sequence of P1-061029_F100fE;

(rrr) a heavy chain comprising the amino acid sequence of the heavy chain of P1-061029_V102D.IgG1.3 and a light chain comprising the light chain amino acid sequence of P1-061029_V102D;

(sss) a heavy chain comprising the amino acid sequence of the heavy chain of P1-061029_Y32E.IgG1.3 and a light chain comprising the light chain amino acid sequence of P1-061029_Y32E;

(ttt) a heavy chain comprising the amino acid sequence of the heavy chain of P1-061029_Y32E_F100fE.IgG1.3 and a light chain comprising the light chain amino acid sequence of P1-061029_Y32E_F100fE;

(uuu) a heavy chain comprising the amino acid sequence of the heavy chain of P1-068744_E31S.IgG1.3 and a light chain comprising the light chain amino acid sequence of P1-068744_E31S;

(vvv) a heavy chain comprising the amino acid sequence of the heavy chain of P1-068744_H50I.IgG1.3 and a light chain comprising the light chain amino acid sequence of P1-068744_H50I;

(www) a heavy chain comprising the amino acid sequence of the heavy chain of P1-068744_E59Y.IgG1.3 and a light chain comprising the light chain amino acid sequence of P1-068744_E59Y;

(xxx) a heavy chain comprising the amino acid sequence of the heavy chain of P1-068744_E100S.IgG1.3 and a light chain comprising the light chain amino acid sequence of P1-068744_E100S;

(yyy) a heavy chain comprising the amino acid sequence of the heavy chain of P1-068744_E102Y.IgG1.3 and a light chain comprising the light chain amino acid sequence of P1-068744_E102Y;

(zzz) a heavy chain comprising the amino acid sequence of the heavy chain of P1-068744_E31S_H50I.IgG1.3 and a light chain comprising the light chain amino acid sequence of P1-068744_E31S_H50I;

(aaaa) a heavy chain comprising the amino acid sequence of the heavy chain of P1-068744_H50I_E59Y.IgG1.3 and a light chain comprising the light chain amino acid sequence of P1-068744_H50I_E59Y;

(bbbb) a heavy chain comprising the amino acid sequence of the heavy chain of P1-068744_E59Y_E100S.IgG1.3 and a light chain comprising the light chain amino acid sequence of P1-068744_E59Y_E100S;

(cccc) a heavy chain comprising the amino acid sequence of the heavy chain of P1-068744_E100S_E102Y.IgG1.3 and a light chain comprising the light chain amino acid sequence of P1-068744_E100S_E102Y;

(dddd) a heavy chain comprising the amino acid sequence of the heavy chain of P1-068744_E31S_E102Y.IgG1.3 and a light chain comprising the light chain amino acid sequence of P1-068744_E31S_E102Y;

(eeee) a heavy chain comprising the amino acid sequence of the heavy chain of P1-068744_E31S_E59Y.IgG1.3 and a light chain comprising the light chain amino acid sequence of P1-068744_E31S_E59Y;

(ffff) a heavy chain comprising the amino acid sequence of the heavy chain of P1-068744_E31S_E100S.IgG1.3 and a light chain comprising the light chain amino acid sequence of P1-068744_E31S_E100S;

(gggg) a heavy chain comprising the amino acid sequence of the heavy chain of P1-068744_H50I_E100S.IgG1.3 and a light chain comprising the light chain amino acid sequence of P1-068744_H50I_E100S;

a heavy chain comprising the amino acid sequence of the heavy chain of P1-(hhhh) 068744_H50I_E102Y.IgG1.3 and a light chain comprising the light chain amino acid sequence of P1-068744_H50I_E102Y;

(iiii) a heavy chain comprising the amino acid sequence of the heavy chain of P1-068744_E59Y_E102Y.IgG1.3 and a VL and a light chain comprising the light chain amino acid sequence of P1-068744_E59Y_E102Y;

(jjjj) a heavy chain comprising the amino acid sequence of the heavy chain of P1-068748_H31S.IgG1.3 and a light chain comprising the light chain amino acid sequence of P1-068748_H31S;

(kkkk) a heavy chain comprising the amino acid sequence of the heavy chain of P1-068748_H32Y.IgG1.3 and a light chain comprising the light chain amino acid sequence of P1-068748_H32Y;

(llll) a heavy chain comprising the amino acid sequence of the heavy chain of P1-068748_D57K.IgG1.3 and a light chain comprising the light chain amino acid sequence of P1-068748_D57K;

(mmmm) a heavy chain comprising the amino acid sequence of the heavy chain of P1-068748_D58Y.IgG1.3 and a light chain comprising the light chain amino acid sequence of P1-068748_D58Y;

(nnnn) a heavy chain comprising the amino acid sequence of the heavy chain of P1-068748_D100S.IgG1.3 and a light chain comprising the light chain amino acid sequence of P1-068748_D100S;

(oooo) a heavy chain comprising the amino acid sequence of the heavy chain of P1-068748_H31S_H32Y.IgG1.3 and a light chain comprising the light chain amino acid sequence of P1-068748_H31S_H32Y;

(pppp) a heavy chain comprising the amino acid sequence of the heavy chain of P1-068748_H32Y_D57K.IgG1.3 and a light chain comprising the light chain amino acid sequence of P1-068748_H32Y_D57K;

(qqqq) a heavy chain comprising the amino acid sequence of the heavy chain of P1-068748_D57K_D58Y.IgG1.3 and a light chain comprising the light chain amino acid sequence of P1-068748_D57K_D58Y;

(rrrr) a heavy chain comprising the amino acid sequence of the heavy chain of

P1-068748_D58Y_D100S.IgG1.3 and a light chain comprising the light chain amino acid sequence of P1-068748_D58Y_D100S;

(ssss) a heavy chain comprising the amino acid sequence of the heavy chain of P1-068748_H31S_D57K.IgG1.3 and a light chain comprising the light chain amino acid sequence of P1-068748_H31S_D57K;

(tttt) a heavy chain comprising the amino acid sequence of the heavy chain of P1-068748_H31S_D58Y.IgG1.3 and a light chain comprising the light chain amino acid sequence of P1-068748_H31S_D58Y;

(uuuu) a heavy chain comprising the amino acid sequence of the heavy chain of P1-068748_H31S_D100S.IgG1.3 and a light chain comprising the light chain amino acid sequence of P1-068748_H31S_D100S;

(vvvv) a heavy chain comprising the amino acid sequence of the heavy chain of P1-068748_H32Y_D58Y.IgG1.3 and a light chain comprising the light chain amino acid sequence of P1-068748_H32Y_D58Y;

(wwww) a heavy chain comprising the amino acid sequence of the heavy chain of P1-068748_H32Y_D100S.IgG1.3 and a light chain comprising the light chain amino acid sequence of P1-068748_H32Y_D100S; or (xxxx) a heavy chain comprising the amino acid sequence of the heavy chain of P1-068748_D57K_D100S.IgG1.3 and a light chain comprising the light chain amino acid sequence of P1-068748_D57K_D100S, optionally wherein the VH in any of (a) or (c) to (ttt) comprises one or both of the K16R and T84A substitutions, and optionally wherein the VL of any of (b) or (uuu) to (xxxx) comprises a T85V substitution.

An anti-h VISTA Ab may comprise:

(a) a heavy chain (HC) comprising the HC CDRs of the HC of P1-061029 and a light chain (LC) comprising the LC CDRs of P1-061029 and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029.IgG1.3, respectively;

(b) a HC comprising the HC CDRs of the HC of P1-061015 and a LC comprising the LC CDRs of P1-061015 and HC and LC amino acid sequences that are at least 90%, at least 91%, at least 92%, at least 93%, at least 94%, at least 95%, at least 96%, at least 97%, at least 98%, or at least 99% identical to the HC and LC of P1-061015.IgG1.3, respectively;

(c) a HC comprising the HC CDRs of the HC of P1-068757 and a LC comprising the LC CDRs of P1-068757 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068757.IgG1.3, respectively;

(d) a HC comprising the HC CDRs of the HC of P1-068759 and a LC comprising the LC CDRs of P1-068759 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068759.IgG1.3, respectively;

(e) a HC comprising the HC CDRs of the HC of P1-068761 and a LC comprising the LC CDRs of P1-068761 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761.IgG1.3, (f) a HC comprising the HC CDRs of the HC of P1-068763 and a LC comprising the LC CDRs of P1-068763 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068763.IgG1.3, respectively;

(g) a HC comprising the HC CDRs of the HC of P1-068765 and a LC comprising the LC CDRs of P1-068765 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068765.IgG1.3, respectively;

(h) a HC comprising the HC CDRs of the HC of P1-068767 and a LC comprising the LC CDRs of P1-068767 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767.IgG1.3, respectively;

(i) a HC comprising the HC CDRs of the HC of P1-068769 and a LC comprising the LC CDRs of P1-068769 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068769.IgG1.3, respectively;

(j) a HC comprising the HC CDRs of the HC of P1-068771 and a LC comprising the LC CDRs of P1-068771 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068771.IgG1.3, respectively;

(k) a HC comprising the HC CDRs of the HC of P1-068773 and a LC comprising the LC CDRs of P1-068773 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068773.IgG1.3, (l) a HC comprising the HC CDRs of the HC of P1-068775 and a LC comprising the LC CDRs of P1-068775 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068775.IgG1.3, respectively;

(m) a HC comprising the HC CDRs of the HC of P1-069059 and a LC comprising the LC CDRs of P1-069059 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069059.IgG1.3, respectively;

(n) a HC comprising the HC CDRs of the HC of P1-069061 and a LC comprising the LC CDRs of P1-069061 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069061.IgG1.3, respectively;

(o) a HC comprising the HC CDRs of the HC of P1-069063 and a LC comprising the LC CDRs of P1-069063 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069063.IgG1.3, respectively;

(p) a HC comprising the HC CDRs of the HC of P1-069065 and a LC comprising the LC CDRs of P1-069065 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069065.IgG1.3, respectively;

(q) a HC comprising the HC CDRs of the HC of P1-069067 and a LC comprising the LC CDRs of P1-069067 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069067.IgG1.3, (r) a HC comprising the HC CDRs of the HC of P1-069069 and a LC comprising the LC CDRs of P1-069069 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069069.IgG1.3, respectively;

(s) a HC comprising the HC CDRs of the HC of P1-069071 and a LC comprising the LC CDRs of P1-069071 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069071.IgG1.3, respectively;

(t) a HC comprising the HC CDRs of the HC of P1-069073 and a LC comprising the LC CDRs of P1-069073 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069073.IgG1.3, respectively;

(u) a HC comprising the HC CDRs of the HC of P1-069075 and a LC comprising the LC CDRs of P1-069075 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069075.IgG1.3, respectively;

(v) a HC comprising the HC CDRs of the HC of P1-069077 and a LC comprising the LC CDRs of P1-069077 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069077.IgG1.3, respectively;

(w) a HC comprising the HC CDRs of the HC of P1-068736 and a LC comprising the LC CDRs of P1-068736 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068736.IgG1.3, (x) a HC comprising the HC CDRs of the HC of P1-068738 and a LC comprising the LC CDRs of P1-068738 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068738.IgG1.3, respectively;

(y) a HC comprising the HC CDRs of the HC of P1-068740 and a LC comprising the LC CDRs of P1-068740 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068740.IgG1.3, respectively;

(z) a HC comprising the HC CDRs of the HC of P1-068742 and a LC comprising the LC CDRs of P1-068742 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068742.IgG1.3, respectively;

(aa) a HC comprising the HC CDRs of the HC of P1-068744 and a LC comprising the LC CDRs of P1-068744 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068744.IgG1.3, respectively;

(bb) a HC comprising the HC CDRs of the HC of P1-068746 and a LC comprising the LC CDRs of P1-068746 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068746.IgG1.3, respectively;

(cc) a HC comprising the HC CDRs of the HC of P1-068748 and a LC comprising the LC CDRs of P1-068748 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068748.IgG1.3, respectively;

(dd) a HC comprising the HC CDRs of the HC of P1-068750 and a LC comprising the LC CDRs of P1-068750 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068750.IgG1.3, respectively;

(ee) a HC comprising the HC CDRs of the HC of P1-068752 and a LC comprising the LC CDRs of P1-068752 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068752.IgG1.3, respectively;

(ff) a HC comprising the HC CDRs of the HC of P1-068754 and a LC comprising the LC CDRs of P1-068754 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068754.IgG1.3, respectively;

(gg) a HC comprising the HC CDRs of the HC of P1-068761_E55A.IgG1.3 and a LC comprising the LC CDRs of P1-068761_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A.IgG1.3, respectively;

(hh) a HC comprising the HC CDRs of the HC of P1-068761_H100G.IgG1.3 and a LC comprising the LC CDRs of P1-068761_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_H100G.IgG1.3, respectively;

(ii) a HC comprising the HC CDRs of the HC of P1-068761_E56N.IgG1.3 and a LC comprising the LC CDRs of P1-068761_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N.IgG1.3, respectively;

(jj) a HC comprising the HC CDRs of the HC of P1-068761_E55A_E56N.IgG1.3 and a LC comprising the LC CDRs of P1-068761_E55A_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A_E56N.IgG1.3, respectively;

(kk) a HC comprising the HC CDRs of the HC of P1-068761_E30D.IgG1.3 and a LC comprising the LC CDRs of P1-068761_E30D and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D.IgG1.3, respectively;

(ll) a HC comprising the HC CDRs of the HC of P1-068761_E30D_E55A.IgG1.3 and a LC comprising the LC CDRs of P1-068761_E30D_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E55A.IgG1.3, respectively;

(mm) a HC comprising the HC CDRs of the HC of P1-068761_E56N_H100G.IgG1.3 and a LC comprising the LC CDRs of P1-068761_E56N_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N_H100G.IgG1.3, respectively;

(nn) a HC comprising the HC CDRs of the HC of P1-068761_E30D_H100G.IgG1.3 and a LC comprising the LC CDRs of P1-068761_E30D_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_H100G.IgG1.3, respectively;

(oo) a HC comprising the HC CDRs of the HC of P1-068761_E30D_E56N.IgG1.3 and a LC comprising the LC CDRs of P1-068761_E30D_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E56N.IgG1.3, respectively;

(pp) a HC comprising the HC CDRs of the HC of P1-068761_E100fF.IgG1.3 and a LC comprising the LC CDRs of P1-068761_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E100fF.IgG1.3, respectively;

(qq) a HC comprising the HC CDRs of the HC of P1-068761_E55A_E100fF.IgG1.3 and a LC comprising the LC CDRs of P1-068761_E55A_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A_E100fF.IgG1.3, respectively;

(rr) a HC comprising the HC CDRs of the HC of P1-068761_H100G_E100fF.IgG1.3 and a LC comprising the LC CDRs of P1-068761_H100G_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_H100G_E100fF.IgG1.3, respectively;

(ss) a HC comprising the HC CDRs of the HC of P1-068761_E30D_E100fF.IgG1.3 and a LC comprising the LC CDRs of P1-068761_E30D_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E100fF.IgG1.3, respectively;

(tt) a HC comprising the HC CDRs of the HC of P1-068761_E56N_E100fF.IgG1.3 and a LC comprising the LC CDRs of P1-068761_E56N_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N_E100fF.IgG1.3, respectively;

(uu) a HC comprising the HC CDRs of the HC of P1-068761_E32Y.IgG1.3 and a LC comprising the LC CDRs of P1-068761_E32Y and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y.IgG1.3, respectively;

(vv) a HC comprising the HC CDRs of the HC of P1-068761_E32Y_E55A.IgG1.3 and a LC comprising the LC CDRs of P1-068761_E32Y_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E55A.IgG1.3, respectively;

(ww) a HC comprising the HC CDRs of the HC of P1-068761_E32Y_E56N.IgG1.3 and a LC comprising the LC CDRs of P1-068761_E32Y_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E56N.IgG1.3, respectively;

(xx) a HC comprising the HC CDRs of the HC of P1-068761_E30D_E32Y.IgG1.3 and a LC comprising the LC CDRs of P1-068761_E30D_E32Y and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E32Y.IgG1.3, respectively;

(yy) a HC comprising the HC CDRs of the HC of P1-068761_E32Y_H100G.IgG1.3 and a LC comprising the LC CDRs of P1-068761_E32Y_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_H100G.IgG1.3, respectively;

(zz) a HC comprising the HC CDRs of the HC of P1-068761_E32Y_E100fF.IgG1.3 and a LC comprising the LC CDRs of P1-068761_E32Y_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E100fF.IgG1.3, respectively;

(aaa) a HC comprising the HC CDRs of the HC of P1-068767_D52N_D102V.IgG1.3 and a LC comprising the LC CDRs of P1-068767_D52N_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_D102V.IgG1.3, respectively;

(bbb) a HC comprising the HC CDRs of the HC of P1-068767_D52N.IgG1.3 and a LC comprising the LC CDRs of P1-068767_D52N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N.IgG1.3, respectively;

(ccc) a HC comprising the HC CDRs of the HC of P1-068767_D52N_E55A.IgG1.3 and a LC comprising the LC CDRs of P1-068767_D52N_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_E55A.IgG1.3, respectively;

(ddd) a HC comprising the HC CDRs of the HC of P1-068767_E55A_D102V.IgG1.3 and a LC comprising the LC CDRs of P1-068767_E55A_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A_D102V.IgG1.3, respectively;

(eee) a HC comprising the HC CDRs of the HC of P1-068767_D102V.IgG1.3 and a LC comprising the LC CDRs of P1-068767_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D102V.IgG1.3, respectively;

(fff) a HC comprising the HC CDRs of the HC of P1-068767_E55A.IgG1.3 and a LC comprising the LC CDRs of P1-068767_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A.IgG1.3, respectively;

(ggg) a HC comprising the HC CDRs of the HC of P1-068767_E30D_D52N.IgG1.3 and a LC comprising the LC CDRs of P1-068767_E30D_D52N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_D52N.IgG1.3, respectively;

(hhh) a HC comprising the HC CDRs of the HC of P1-068767_E30D_D102V.IgG1.3 and a LC comprising the LC CDRs of P1-068767_E30D_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_D102V.IgG1.3, respectively;

(iii) a HC comprising the HC CDRs of the HC of P1-068767_E30D.IgG1.3 and a LC comprising the LC CDRs of P1-068767_E30D and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D.IgG1.3, respectively;

(jjj) a HC comprising the HC CDRs of the HC of P1-068767_E30D_E55A.IgG1.3 and a LC comprising the LC CDRs of P1-068767_E30D_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_E55A.IgG1.3, respectively;

(kkk) a HC comprising the HC CDRs of the HC of P1-068767_E100fF_D102V.IgG1.3 and a LC comprising the LC CDRs of P1-068767_E100fF_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E100fF_D102V.IgG1.3, respectively;

(lll) a HC comprising the HC CDRs of the HC of P1-068767_E55A_E100fF.IgG1.3 and a LC comprising the LC CDRs of P1-068767_E55A_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A_E100fF.IgG1.3, respectively;

(mmm) a HC comprising the HC CDRs of the HC of P1-068767_D52N_E100fF.IgG1.3 and a LC comprising the LC CDRs of P1-068767_D52N_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_E100fF.IgG1.3, respectively;

(nnn) a HC comprising the HC CDRs of the HC of P1-068767_E100fF.IgG1.3 and a LC comprising the LC CDRs of P1-068767_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E100fF.IgG1.3, respectively;

(ooo) a HC comprising the HC CDRs of the HC of P1-068767_E30D_E100fF.IgG1.3 and a LC comprising the LC CDRs of P1-068767_E30D_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_E100fF.IgG1.3, respectively;

(ppp) a HC comprising the HC CDRs of the HC of P1-061029_F100fE_V102D.IgG1.3 and a LC comprising the LC CDRs of P1-061029_F100fE_V102D and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_F100fE_V102D.IgG1.3, respectively;

(qqq) a HC comprising the HC CDRs of the HC of P1-061029_F100fE.IgG1.3 and a LC comprising the LC CDRs of P1-061029_F100fE and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_F100fE.IgG1.3, respectively;

(rrr) a HC comprising the HC CDRs of the HC of P1-061029_V102D.IgG1.3 and a LC comprising the LC CDRs of P1-061029_V102D and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_V102D.IgG1.3, respectively;

(sss) a HC comprising the HC CDRs of the HC of P1-061029_Y32E.IgG1.3 and a LC comprising the LC CDRs of P1-061029_Y32E and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_Y32E.IgG1.3, respectively;

(ttt) a HC comprising the HC CDRs of the HC of P1-061029_Y32E_F100fE.IgG1.3 and a LC comprising the LC CDRs of P1-061029_Y32E_F100fE and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_Y32E_F100fE.IgG1.3, respectively;

(uuu) a HC comprising the HC CDRs of the HC of P1-068744_E31S and a LC comprising the LC CDRs of P1-068744_E31S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E31S.IgG1.3, respectively;

(vvv) a HC comprising the HC CDRs of the HC of P1-068744_H50I and a LC comprising the LC CDRs of P1-068744_H50I and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_H50I.IgG1.3, respectively;

(www) a HC comprising the HC CDRs of the HC of P1-068744_E59Y and a LC comprising the LC CDRs of P1-068744_E59Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E59Y.IgG1.3, respectively;

(xxx) a HC comprising the HC CDRs of the HC of P1-068744_E100S and a LC comprising the LC CDRs of P1-068744_E100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E100S.IgG1.3, respectively;

(yyy) a HC comprising the HC CDRs of the HC of P1-068744_E102Y and a LC comprising the LC CDRs of P1-068744_E102Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E102Y.IgG1.3, respectively;

(zzz) a HC comprising the HC CDRs of the HC of P1-068744_E31S_H50I and a LC comprising the LC CDRs of P1-068744_E31S_H50I and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E31S_H50I.IgG1.3, respectively;

(aaaa) a HC comprising the HC CDRs of the HC of P1-068744_H50I_E59Y and a LC comprising the LC CDRs of P1-068744_H50I_E59Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E59Y.IgG1.3, respectively;

(bbbb) a HC comprising the HC CDRs of the HC of P1-068744_E59Y_E100S and a LC comprising the LC CDRs of P1-068744_E5;9Y_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E59Y_E100S.IgG1.3, respectively;

(cccc) a HC comprising the HC CDRs of the HC of P1-068744_E100S_E102Y and a LC comprising the LC CDRs of P1-068744_E100S_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E100S_E102Y.IgG1.3, respectively;

(dddd) a HC comprising the HC CDRs of the HC of P1-068744_E31S_E102Y and a LC comprising the LC CDRs of P1-068744_E31S_E102Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E102Y.IgG1.3, respectively;

(eeee) a HC comprising the HC CDRs of the HC of P1-068744_E31S_E59Y and a LC comprising the LC CDRs of P1-068744_E31S_E59Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E59Y.IgG1.3, respectively;

(ffff) a HC comprising the HC CDRs of the HC of P1-068744_E31S_E100S and a LC comprising the LC CDRs of P1-068744_E31S_E100S and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744_E31S_E100S.IgG1.3, respectively;

(gggg) a HC comprising the HC CDRs of the HC of P1-068744_H50I_E100S and a LC comprising the LC CDRs of P1-068744_H50I_E100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E100S.IgG1.3, respectively;

(hhhh) a HC comprising the HC CDRs of the HC of P1-068744_H50I_E102Y and a LC comprising the LC CDRs of P1-068744_H50I_E102Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_H50I_E102Y.IgG1.3, respectively;

(iiii) a HC comprising the HC CDRs of the HC of P1-068744_E59Y_E102Y and a LC comprising the LC CDRs of P1-068744_E59Y_E102Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068744_E59Y_E102Y.IgG1.3, respectively;

(jjjj) a HC comprising the HC CDRs of the HC of P1-068748_H31S and a LC comprising the LC CDRs of P1-068748_H31S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H31S.IgG1.3, respectively;

(kkkk) a HC comprising the HC CDRs of the HC of P1-068748_H32Y and a LC comprising the LC CDRs of P1-068748_H32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748_H32Y.IgG1.3, respectively;

(llll) a HC comprising the HC CDRs of the HC of P1-068748_D57K and a LC comprising the LC CDRs of P1-068748_D57K and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D57K.IgG1.3, respectively;

(mmmm) a HC comprising the HC CDRs of the HC of P1-068748_D58Y and a LC comprising the LC CDRs of P1-068748_D58Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D58Y.IgG1.3, respectively;

(nnnn) a HC comprising the HC CDRs of the HC of P1-068748_D100S and a LC comprising the LC CDRs of P1-068748_D100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D100S.IgG1.3, respectively;

(oooo) a HC comprising the HC CDRs of the HC of P1-068748_H31S_H32Y and a LC comprising the LC CDRs of P1-068748_H31S_H32Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H31S_H32Y.IgG1.3, respectively;

(pppp) a HC comprising the HC CDRs of the HC of P1-068748_H32Y_D57K and a LC comprising the LC CDRs of P1-068748_H32Y_D57K and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D57K.IgG1.3, respectively;

(qqqq) a HC comprising the HC CDRs of the HC of P1-068748_D57K_D58Y and a LC comprising the LC CDRs of P1-068748_D57K_D58Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D57K_D58Y.IgG1.3, respectively;

(rrrr) a HC comprising the HC CDRs of the HC of P1-068748_D58Y_D100S and a LC comprising the LC CDRs of P1-068748_D58Y_D100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D58Y_D100S.IgG1.3, respectively;

(ssss) a HC comprising the HC CDRs of the HC of P1-068748_H31S_D57K and a LC comprising the LC CDRs of P1-068748_H31S_D57K and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D57K.IgG1.3, respectively;

(tttt) a HC comprising the HC CDRs of the HC of P1-068748_H31S_D58Y and a LC comprising the LC CDRs of P1-068748_H31S_D58Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D58Y.IgG1.3, respectively;

(uuuu) a HC comprising the HC CDRs of the HC of P1-068748_H31S_D100S and a LC comprising the LC CDRs of P1-068748_H31S_D100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H31S_D100S.IgG1.3, respectively;

(vvvv) a HC comprising the HC CDRs of the HC of P1-068748_H32Y_D58Y and a LC comprising the LC CDRs of P1-068748_H32Y_D58Y and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D58Y.IgG1.3, respectively;

(wwww) a HC comprising the HC CDRs of the HC of P1-068748_H32Y_D100S and a LC comprising the LC CDRs of P1-068748_H32Y_D100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_H32Y_D100S.IgG1.3, respectively; or (xxxx) a HC comprising the HC CDRs of the HC of P1-068748_D57K_D100S and a LC comprising the LC CDRs of P1-068748_D57K_D100S and HC and LC amino acid sequences that are at least 90%, at least 91%, at least 92%, at least 93%, at least 94%, at least 95%, at least 96%, at least 97%, at least 98%, or at least 99% identical to the VH and VL of P1-068748_D57K_D100S.IgG1.3, respectively.

In some of the above embodiments, the HC and/or LC may differ from the sequence of each of the species (a) to (ttt) by the presence of 1, 2, 3, 4, or 5 amino acid substitutions, such as 1, 2, 3, 4, or 5 conservative substitutions. In some embodiments, for example, the HC of P1-061029 or one of its progeny may comprise one or both of the K16R and T84A substitutions in the VH region of the HC (P1-061015 and its progeny already have an R and an A at those positions, respectively). In some embodiments, the LC of P1-061015 or its progeny may comprise a T85V substitution.

In some embodiments, an anti-hVISTA Ab may comprise:

(a) a heavy chain consisting of the amino acid sequence of the heavy chain of P1-061029.IgG1.3 and a light chain consisting of the amino acid sequence of the light chain of P1-061029;

(b) a heavy chain consisting of the amino acid sequence of the heavy chain of P1-061015.IgG1.3 and a light chain consisting of the amino acid sequence of the light chain of P1-061015;

(c) a heavy chain consisting of the amino acid sequence of the heavy chain of P1-068757.IgG1.3 and a light chain consisting of the amino acid sequence of the light chain of P1-068757;

(d) a heavy chain consisting of the amino acid sequence of the heavy chain of P1-068759.IgG1.3 and a light chain consisting of the amino acid sequence of the light chain of P1-068759;

(e) a heavy chain consisting of the amino acid sequence of the heavy chain of P1-068761.IgG1.3 and a light chain consisting of the amino acid sequence of the light chain of P1-068761;

(f) a heavy chain consisting of the amino acid sequence of the heavy chain of P1-068763.IgG1.3 and a light chain consisting of the amino acid sequence of the light chain of P1-068763;

(g) a heavy chain consisting of the amino acid sequence of the heavy chain of P1-068765.IgG1.3 and a light chain consisting of the amino acid sequence of the light chain of P1-068765;

(h) a heavy chain consisting of the amino acid sequence of the heavy chain of P1-068767.IgG1.3 and a light chain consisting of the amino acid sequence of the light chain of P1-068767;

(i) a heavy chain consisting of the amino acid sequence of the heavy chain of P1-068769.IgG1.3 and a light chain consisting of the amino acid sequence of the light chain of P1-068769;

(j) a heavy chain consisting of the amino acid sequence of the heavy chain of P1-068771.IgG1.3 and a light chain consisting of the amino acid sequence of the light chain of P1-068771;

(k) a heavy chain consisting of the amino acid sequence of the heavy chain of P1-068773.IgG1.3 and a light chain consisting of the amino acid sequence of the light chain of P1-068773;

(l) a heavy chain consisting of the amino acid sequence of the heavy chain of P1-068775.IgG1.3 and a light chain consisting of the amino acid sequence of the light chain of P1-068775;

(m) a heavy chain consisting of the amino acid sequence of the heavy chain of P1-069059.IgG1.3 and a light chain consisting of the amino acid sequence of the light chain of P1-069059;

(n) a heavy chain consisting of the amino acid sequence of the heavy chain of P1-069061.IgG1.3 and a light chain consisting of the amino acid sequence of the light chain of P1-069061;

(o) a heavy chain consisting of the amino acid sequence of the heavy chain of P1-069063.IgG1.3 and a light chain consisting of the amino acid sequence of the light chain of P1-069063;

(p) a heavy chain consisting of the amino acid sequence of the heavy chain of P1-069065.IgG1.3 and a light chain consisting of the amino acid sequence of the light chain of P1-069065;

(q) a heavy chain consisting of the amino acid sequence of the heavy chain of P1-069067.IgG1.3 and a light chain consisting of the amino acid sequence of the light chain of P1-069067;

(r) a heavy chain consisting of the amino acid sequence of the heavy chain of P1-069069.IgG1.3 and a light chain consisting of the amino acid sequence of the light chain of P1-069069;

(s) a heavy chain consisting of the amino acid sequence of the heavy chain of P1-069071.IgG1.3 and a light chain consisting of the amino acid sequence of the light chain of P1-069071;

(t) a heavy chain consisting of the amino acid sequence of the heavy chain of P1-069073.IgG1.3 and a light chain consisting of the amino acid sequence of the light chain of P1-069073;

(u) a heavy chain consisting of the amino acid sequence of the heavy chain of P1-069075.IgG1.3 and a light chain consisting of the amino acid sequence of the light chain of P1-069075;

(v) a heavy chain consisting of the amino acid sequence of the heavy chain of P1-069077.IgG1.3 and a light chain consisting of the amino acid sequence of the light chain of P1-069077;

(w) a heavy chain consisting of the amino acid sequence of the heavy chain of P1-068736.IgG1.3 and a light chain consisting of the amino acid sequence of the light chain of P1-068736;

(x) a heavy chain consisting of the amino acid sequence of the heavy chain of P1-068738.IgG1.3 and a light chain consisting of the amino acid sequence of the light chain of P1-068738;

(y) a heavy chain consisting of the amino acid sequence of the heavy chain of P1-068740.IgG1.3 and a light chain consisting of the amino acid sequence of the light chain of P1-068740;

(z) a heavy chain consisting of the amino acid sequence of the heavy chain of P1-068742.IgG1.3 and a light chain consisting of the amino acid sequence of the light chain of P1-068742;

(aa) a heavy chain consisting of the amino acid sequence of the heavy chain of P1-068744.IgG1.3 and a light chain consisting of the amino acid sequence of the light chain of P1-068744;

(bb) a heavy chain consisting of the amino acid sequence of the heavy chain of P1-068746.IgG1.3 and a light chain consisting of the amino acid sequence of the light chain of P1-068746;

(cc) a heavy chain consisting of the amino acid sequence of the heavy chain of P1-068748.IgG1.3 and a light chain consisting of the amino acid sequence of the light chain of P1-068748;

(dd) a heavy chain consisting of the amino acid sequence of the heavy chain of P1-068750.IgG1.3 and a light chain consisting of the amino acid sequence of the light chain of P1-068750;

(ee) a heavy chain consisting of the amino acid sequence of the heavy chain of P1-068752.IgG1.3 and a light chain consisting of the amino acid sequence of the light chain of P1-068752;

(ff) a heavy chain consisting of the amino acid sequence of the heavy chain of P1-068754.IgG1.3 and a light chain consisting of the amino acid sequence of the light chain of P1-068754;

(gg) a heavy chain consisting of the amino acid sequence of the heavy chain of P1-068761_E55A.IgG1.3 and a light chain consisting of the amino acid sequence of the light chain of P1-068761_E55A;

(hh) a heavy chain consisting of the amino acid sequence of the heavy chain of P1-068761_H100G.IgG1.3 and a light chain consisting of the amino acid sequence of the light chain of P1-068761_H100G;

(ii) a heavy chain consisting of the amino acid sequence of the heavy chain of P1-068761_E56N.IgG1.3 and a light chain consisting of the amino acid sequence of the light chain of P1-068761_E56N;

(jj) a heavy chain consisting of the amino acid sequence of the heavy chain of P1-068761_E55A_E56N.IgG1.3 and a light chain consisting of the amino acid sequence of the light chain of P1-068761_E55A_E56N;

(kk) a heavy chain consisting of the amino acid sequence of the heavy chain of P1-068761_E30D.IgG1.3 and a light chain consisting of the amino acid sequence of the light chain of P1-068761_E30D;

(ll) a heavy chain consisting of the amino acid sequence of the heavy chain of P1-068761_E30D_E55A.IgG1.3 and a light chain consisting of the amino acid sequence of the light chain of P1-068761_E30D_E55A;

(mm) a heavy chain consisting of the amino acid sequence of the heavy chain of P1-068761_E56N_H100G.IgG1.3 and a light chain consisting of the amino acid sequence of the light chain of P1-068761_E56N_H100G;

(nn) a heavy chain consisting of the amino acid sequence of the heavy chain of P1-068761_E30D_H100G.IgG1.3 and a light chain consisting of the amino acid sequence of the light chain of P1-068761_E30D_H100G;

(oo) a heavy chain consisting of the amino acid sequence of the heavy chain of P1-068761_E30D_E56N.IgG1.3 and a light chain consisting of the amino acid sequence of the light chain of P1-068761_E30D_E56N;

(pp) a heavy chain consisting of the amino acid sequence of the heavy chain of P1-068761_E100fF.IgG1.3 and a light chain consisting of the amino acid sequence of the light chain of P1-068761_E100fF;

(qq) a heavy chain consisting of the amino acid sequence of the heavy chain of P1-068761_E55A_E100fF.IgG1.3 and a light chain consisting of the amino acid sequence of the light chain of P1-068761_E55A_E100fF;

(rr) a heavy chain consisting of the amino acid sequence of the heavy chain of P1-068761_H100G_E100fF.IgG1.3 and a light chain consisting of the amino acid sequence of the light chain of P1-068761_H100G_E100fF;

(ss) a heavy chain consisting of the amino acid sequence of the heavy chain of P1-068761_E30D_E100fF.IgG1.3 and a light chain consisting of the amino acid sequence of the light chain of P1-068761_E30D_E100fF;

(tt) a heavy chain consisting of the amino acid sequence of the heavy chain of P1-068761_E56N_E100fF.IgG1.3 and a light chain consisting of the amino acid sequence of the light chain of P1-068761_E56N_E100fF;

(uu) a heavy chain consisting of the amino acid sequence of the heavy chain of P1-068761_E32Y.IgG1.3 and a light chain consisting of the amino acid sequence of the light chain of P1-068761_E32Y;

(vv) a heavy chain consisting of the amino acid sequence of the heavy chain of P1-068761_E32Y_E55A.IgG1.3 and a light chain consisting of the amino acid sequence of the light chain of P1-068761_E32Y_E55A;

(ww) a heavy chain consisting of the amino acid sequence of the heavy chain of P1-068761_E32Y_E56N.IgG1.3 and a light chain consisting of the amino acid sequence of the light chain of P1-068761_E32Y_E56N;

(xx) a heavy chain consisting of the amino acid sequence of the heavy chain of P1-068761_E30D_E32Y.IgG1.3 and a light chain consisting of the amino acid sequence of the light chain of P1-068761_E30D_E32Y;

(yy) a heavy chain consisting of the amino acid sequence of the heavy chain of P1-068761_E32Y_H100G.IgG1.3 and a light chain consisting of the amino acid sequence of the light chain of P1-068761_E32Y_H100G;

(zz) a heavy chain consisting of the amino acid sequence of the heavy chain of P1-068761_E32Y_E100fF.IgG1.3 and a light chain consisting of the amino acid sequence of the light chain of P1-068761_E32Y_E100fF;

(aaa) a heavy chain consisting of the amino acid sequence of the heavy chain of P1-068767_D52N_D102V.IgG1.3 and a light chain consisting of the amino acid sequence of the light chain of P1-068767_D52N_D102V;

(bbb) a heavy chain consisting of the amino acid sequence of the heavy chain of P1-068767_D52N.IgG1.3 and a light chain consisting of the amino acid sequence of the light chain of P1-068767_D52N;

(ccc) a heavy chain consisting of the amino acid sequence of the heavy chain of P1-068767_D52N_E55A.IgG1.3 and a light chain consisting of the amino acid sequence of the light chain of P1-068767_D52N_E55A;

(ddd) a heavy chain consisting of the amino acid sequence of the heavy chain of P1-068767_E55A_D102V.IgG1.3 and a light chain consisting of the amino acid sequence of the light chain of P1-068767_E55A_D102V;

(eee) a heavy chain consisting of the amino acid sequence of the heavy chain of P1-068767_D102V.IgG1.3 and a light chain consisting of the amino acid sequence of the light chain of P1-068767_D102V;

(fff) a heavy chain consisting of the amino acid sequence of the heavy chain of P1-068767_E55A.IgG1.3 and a light chain consisting of the amino acid sequence of the light chain of P1-068767_E55A;

(ggg) a heavy chain consisting of the amino acid sequence of the heavy chain of P1-068767_E30D_D52N.IgG1.3 and a light chain consisting of the amino acid sequence of the light chain of P1-068767_E30D_D52N;

(hhh) a heavy chain consisting of the amino acid sequence of the heavy chain of P1-068767_E30D_D102V.IgG1.3 and a light chain consisting of the amino acid sequence of the light chain of P1-068767_E30D_D102V;

(iii) a heavy chain consisting of the amino acid sequence of the heavy chain of P1-068767_E30D.IgG1.3 and a light chain consisting of the amino acid sequence of the light chain of P1-068767_E30D;

(jjj) a heavy chain consisting of the amino acid sequence of the heavy chain of P1-068767_E30D_E55A.IgG1.3 and a light chain consisting of the amino acid sequence of the light chain of P1-068767_E30D_E55A;

(kkk) a heavy chain consisting of the amino acid sequence of the heavy chain of P1-068767_E100fF_D102V.IgG1.3 and a light chain consisting of the amino acid sequence of the light chain of P1-068767_E100fF_D102V;

(lll) a heavy chain consisting of the amino acid sequence of the heavy chain of P1-068767_E55A_E100fF.IgG1.3 and a light chain consisting of the amino acid sequence of the light chain of P1-068767_E55A_E100fF;

(mmm) a heavy chain consisting of the amino acid sequence of the heavy chain of P1-068767_D52N_E100fF.IgG1.3 and a light chain consisting of the amino acid sequence of the light chain of P1-068767_D52N_E100fF;

(nnn) a heavy chain consisting of the amino acid sequence of the heavy chain of P1-068767_E100fF.IgG1.3 and a light chain consisting of the amino acid sequence of the light chain of P1-068767_E100fF;

(ooo) a heavy chain consisting of the amino acid sequence of the heavy chain of P1-068767_E30D_E100fF.IgG1.3 and a light chain consisting of the amino acid sequence of the light chain of P1-068767_E30D_E100fF;

(ppp) a heavy chain consisting of the amino acid sequence of the heavy chain of P1-061029_F100fE_V102D.IgG1.3 and a light chain consisting of the amino acid sequence of the light chain of P1-061029_F100fE_V102D;

(qqq) a heavy chain consisting of the amino acid sequence of the heavy chain of P1-061029_F100fE.IgG1.3 and a light chain consisting of the amino acid sequence of the light chain of P1-061029_F100fE;

(rrr) a heavy chain consisting of the amino acid sequence of the heavy chain of P1-061029_V102D.IgG1.3 and a light chain consisting of the amino acid sequence of the light chain of P1-061029_V102D;

(sss) a heavy chain consisting of the amino acid sequence of the heavy chain of P1-061029_Y32E.IgG1.3 and a light chain consisting of the amino acid sequence of the light chain of P1-061029_Y32E;

(ttt) a heavy chain consisting of the amino acid sequence of the heavy chain of P1-061029_Y32E_F100fE.IgG1.3 and a light chain consisting of the amino acid sequence of the light chain of P1-061029_Y32E_F100fE (uuu) a heavy chain consisting of the amino acid sequence of the heavy chain of P1-068744_E31S.IgG1.3 and a light chain consisting of the light chain amino acid sequence of P1-068744_E31S;

(vvv) a heavy chain consisting of the amino acid sequence of the heavy chain of P1-068744_H50I.IgG1.3 and a light chain consisting of the light chain amino acid sequence of P1-068744_H50I;

(www) a heavy chain consisting of the amino acid sequence of the heavy chain of P1-068744_E59Y.IgG1.3 and a light chain consisting of the light chain amino acid sequence of P1-068744_E59Y;

(xxx) a heavy chain consisting of the amino acid sequence of the heavy chain of P1-068744_E100S.IgG1.3 and a light chain consisting of the light chain amino acid sequence of P1-068744_E100S;

(yyy) a heavy chain consisting of the amino acid sequence of the heavy chain of P1-068744_E102Y.IgG1.3 and a light chain consisting of the light chain amino acid sequence of P1-068744_E102Y;

(zzz) a heavy chain consisting of the amino acid sequence of the heavy chain of P1-068744_E31S_H50I.IgG1.3 and a light chain consisting of the light chain amino acid sequence of P1-068744_E31S_H50I;

(aaaa) a heavy chain consisting of the amino acid sequence of the heavy chain of P1-068744_H50I_E59Y.IgG1.3 and a light chain consisting of the light chain amino acid sequence of P1-068744_H50I_E59Y;

(bbbb) a heavy chain consisting of the amino acid sequence of the heavy chain of P1-068744_E59Y_E100S.IgG1.3 and a light chain consisting of the light chain amino acid sequence of P1-068744_E5;9Y_E100S;

(cccc) a heavy chain consisting of the amino acid sequence of the heavy chain of P1-068744_E100S_E102Y.IgG1.3 and a light chain consisting of the light chain amino acid sequence of P1-068744_E100S_E102Y;

(dddd) a heavy chain consisting of the amino acid sequence of the heavy chain of P1-068744_E31S_E102Y.IgG1.3 and a light chain consisting of the light chain amino acid sequence of P1-068744_E31S_E102Y;

(eeee) a heavy chain consisting of the amino acid sequence of the heavy chain of P1-068744_E31S_E59Y.IgG1.3 and a light chain consisting of the light chain amino acid sequence of P1-068744_E31S_E59Y;

(ffff) a heavy chain comprising the amino acid sequence of the heavy chain of P1-068744_E31S_E100S.IgG1.3 and a light chain comprising the light chain amino acid sequence of P1-068744_E31S_E100S;

(gggg) a heavy chain consisting of the amino acid sequence of the heavy chain of P1-068744_H50I_E100S.IgG1.3 and a light chain consisting of the light chain amino acid sequence of P1-068744_H50I_E100S;

(hhhh) a heavy chain consisting of the amino acid sequence of the heavy chain of P1-068744_H50I_E102Y.IgG1.3 and a light chain consisting of the light chain amino acid sequence of P1-068744_H50I_E102Y;

(iiii) a heavy chain consisting of the amino acid sequence of the heavy chain of P1-068744_E59Y_E102Y.IgG1.3 and a VL and a light chain consisting of the light chain amino acid sequence of P1-068744_E59Y_E102Y;

(jjjj) a heavy chain consisting of the amino acid sequence of the heavy chain of P1-068748_H31S.IgG1.3 and a light chain consisting of the light chain amino acid sequence of P1-068748_H31S;

(kkkk) a heavy chain consisting of the amino acid sequence of the heavy chain of P1-068748_H32Y.IgG1.3 and a light chain consisting of the light chain amino acid sequence of P1-068748_H32Y;

(llll) a heavy chain consisting of the amino acid sequence of the heavy chain of P1-068748_D57K.IgG1.3 and a light chain consisting of the light chain amino acid sequence of P1-068748_D57K;

(mmmm) a heavy chain consisting of the amino acid sequence of the heavy chain of P1-068748_D58Y.IgG1.3 and a light chain consisting of the light chain amino acid sequence of P1-068748_D58Y;

(nnnn) a heavy chain consisting of the amino acid sequence of the heavy chain of P1-068748_D100S.IgG1.3 and a light chain consisting of the light chain amino acid sequence of P1-068748_D100S;

(oooo) a heavy chain consisting of the amino acid sequence of the heavy chain of P1-068748_H31S_H32Y.IgG1.3 and a light chain consisting of the light chain amino acid sequence of P1-068748_H31S_H32Y;

(pppp) a heavy chain consisting of the amino acid sequence of the heavy chain of P1-068748_H32Y_D57K.IgG1.3 and a light chain consisting of the light chain amino acid sequence of P1-068748_H32Y_D57K;

(qqqq) a heavy chain consisting of the amino acid sequence of the heavy chain of P1-068748_D57K_D58Y.IgG1.3 and a light chain consisting of the light chain amino acid sequence of P1-068748_D57K_D58Y;

(rrrr) a heavy chain consisting of the amino acid sequence of the heavy chain of P1-068748_D58Y_D100S.IgG1.3 and a light chain consisting of the light chain amino acid sequence of P1-068748_D58Y_D100S;

(ssss) a heavy chain consisting of the amino acid sequence of the heavy chain of P1-068748_H31S_D57K.IgG1.3 and a light chain consisting of the light chain amino acid sequence of P1-068748_H31S_D57K;

(tttt) a heavy chain consisting of the amino acid sequence of the heavy chain of P1-068748_H31S_D58Y.IgG1.3 and a light chain consisting of the light chain amino acid sequence of P1-068748_H31S_D58Y;

(uuuu) a heavy chain consisting of the amino acid sequence of the heavy chain of P1-068748_H31S_D100S.IgG1.3 and a light chain consisting of the light chain amino acid sequence of P1-068748_H31S_D100S;

(vvvv) a heavy chain consisting of the amino acid sequence of the heavy chain of P1-068748_H32Y_D58Y.IgG1.3 and a light chain consisting of the light chain amino acid sequence of P1-068748_H32Y_D58Y;

(wwww) a heavy chain consisting of the amino acid sequence of the heavy chain of P1-068748_H32Y_D100S.IgG1.3 and a light chain consisting of the light chain amino acid sequence of P1-068748_H32Y_D100S; or (xxxx) a heavy chain consisting of the amino acid sequence of the heavy chain of P1-068748_D57K_D100S.IgG1.3 and a light chain consisting of the light chain amino acid sequence of P1-068748_D57K_D100S, optionally wherein the VH in any of (a) or (c) to (ttt) comprises one or both of the K16R and T84A substitutions, and optionally wherein the VL in (b) or (uuu)-(xxxx) comprises a T85V substitution.

In some embodiments, the disclosure contemplates anti-VISTA mAbs comprising:

a heavy chain consisting of the amino acid sequences of the heavy chain of (a) to (ttt) listed above followed by a Lys residue; and a light chain consisting of the light chain amino acid sequence of (a) to (ttt) listed above;

wherein the heavy chain and light chain amino acid sequences are chosen from the same antibody species from among (a) to (ttt) listed above.

In some embodiments, an anti-hVISTA Ab may comprise a heavy chain amino acid sequence comprising the VH amino acid sequence of the antibody species herein, but rather than an IgG1.3 heavy chain constant region, as provided in the HC sequences in the Sequence Table herein (and see SEQ ID NO: 163), the antibody may comprise a different heavy chain constant region sequence, such as a human wild-type IgG1 constant region such as human IgG1 allotype f (IgG1f) (SEQ ID NO: 182), or a modified human IgG1 constant region such as IgG1.If (SEQ ID NO: 183), or a modified human IgG1 constant region such as IgG1.P238K (SEQ ID NO: 184). Accordingly, embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 182, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 182, and a light chain comprising the light chain amino acid sequence of P1-061015;

(c) a heavy chain comprising (i) the amino acid sequence of the VH of P1-068757 and (ii) the amino acid sequence of SEQ ID NO: 182, and a light chain comprising the light chain amino acid sequence of P1-068757;

(d) a heavy chain comprising (i) the amino acid sequence of the VH of P1-068759 and (ii) the amino acid sequence of SEQ ID NO: 182, and a light chain comprising the light chain amino acid sequence of P1-068759;

(e) a heavy chain comprising (i) the amino acid sequence of the VH of P1-068761 and (ii) the amino acid sequence of SEQ ID NO: 182, and a light chain comprising the light chain amino acid sequence of P1-068761;

(f) a heavy chain comprising (i) the amino acid sequence of the VH of P1-068763 and (ii) the amino acid sequence of SEQ ID NO: 182, and a light chain comprising the light chain amino acid sequence of P1-068763;

(g) a heavy chain comprising (i) the amino acid sequence of the VH of P1-068765 and (ii) the amino acid sequence of SEQ ID NO: 182, and a light chain comprising the light chain amino acid sequence of P1-068765;

(h) a heavy chain comprising (i) the amino acid sequence of the VH of P1-068767 and (ii) the amino acid sequence of SEQ ID NO: 182, and a light chain comprising the light chain amino acid sequence of P1-068767;

(i) a heavy chain comprising (i) the amino acid sequence of the VH of P1-068769 and (ii) the amino acid sequence of SEQ ID NO: 182, and a light chain comprising the light chain amino acid sequence of P1-068769;

(j) a heavy chain comprising (i) the amino acid sequence of the VH of P1-068771 and (ii) the amino acid sequence of SEQ ID NO: 182, and a light chain comprising the light chain amino acid sequence of P1-068771;

(k) a heavy chain comprising (i) the amino acid sequence of the VH of P1-068773 and (ii) the amino acid sequence of SEQ ID NO: 182, and a light chain comprising the light chain amino acid sequence of P1-068773;

(l) a heavy chain comprising (i) the amino acid sequence of the VH of P1-068775 and (ii) the amino acid sequence of SEQ ID NO: 182, and a light chain comprising the light chain amino acid sequence of P1-068775;

(m) a heavy chain comprising (i) the amino acid sequence of the VH of P1-069059 and (ii) the amino acid sequence of SEQ ID NO: 182, and a light chain comprising the light chain amino acid sequence of P1-069059;

(n) a heavy chain comprising (i) the amino acid sequence of the VH of P1-069061 and (ii) the amino acid sequence of SEQ ID NO: 182, and a light chain comprising the light chain amino acid sequence of P1-069061;

(o) a heavy chain comprising (i) the amino acid sequence of the VH of P1-069063 and (ii) the amino acid sequence of SEQ ID NO: 182, and a light chain comprising the light chain amino acid sequence of P1-069063;

(p) a heavy chain comprising (i) the amino acid sequence of the VH of P1-069065 and (ii) the amino acid sequence of SEQ ID NO: 182, and a light chain comprising the light chain amino acid sequence of P1-069065;

(q) a heavy chain comprising (i) the amino acid sequence of the VH of P1-069067 and (ii) the amino acid sequence of SEQ ID NO: 182, and a light chain comprising the light chain amino acid sequence of P1-069067;

(r) a heavy chain comprising (i) the amino acid sequence of the VH of P1-069069 and (ii) the amino acid sequence of SEQ ID NO: 182, and a light chain comprising the light chain amino acid sequence of P1-069069;

(s) a heavy chain comprising (i) the amino acid sequence of the VH of P1-069071 and (ii) the amino acid sequence of SEQ ID NO: 182, and a light chain comprising the light chain amino acid sequence of P1-069071;

(t) a heavy chain comprising (i) the amino acid sequence of the VH of P1-069073 and (ii) the amino acid sequence of SEQ ID NO: 182, and a light chain comprising the light chain amino acid sequence of P1-069073;

(u) a heavy chain comprising (i) the amino acid sequence of the VH of P1-069075 and (ii) the amino acid sequence of SEQ ID NO: 182, and a light chain comprising the light chain amino acid sequence of P1-069075;

(v) a heavy chain comprising (i) the amino acid sequence of the VH of P1-069077 and (ii) the amino acid sequence of SEQ ID NO: 182, and a light chain comprising the light chain amino acid sequence of P1-069077;

(w) a heavy chain comprising (i) the amino acid sequence of the VH of P1-068736 and (ii) the amino acid sequence of SEQ ID NO: 182, and a light chain comprising the light chain amino acid sequence of P1-068736;

(x) a heavy chain comprising (i) the amino acid sequence of the VH of P1-068738 and (ii) the amino acid sequence of SEQ ID NO: 182, and a light chain comprising the light chain amino acid sequence of P1-068738;

(y) a heavy chain comprising (i) the amino acid sequence of the VH of P1-068740 and (ii) the amino acid sequence of SEQ ID NO: 182, and a light chain comprising the light chain amino acid sequence of P1-068740;

(z) a heavy chain comprising (i) the amino acid sequence of the VH of P1-068742 and (ii) the amino acid sequence of SEQ ID NO: 182, and a light chain comprising the light chain amino acid sequence of P1-068742;

(aa) a heavy chain comprising (i) the amino acid sequence of the VH of P1-068744 and (ii) the amino acid sequence of SEQ ID NO: 182, and a light chain comprising the light chain amino acid sequence of P1-068744;

(bb) a heavy chain comprising the amino acid sequence of the VH of P1-068746 and (ii) the amino acid sequence of SEQ ID NO: 182, and a light chain comprising the light chain amino acid sequence of P1-068746;

(cc) a heavy chain comprising (i) the amino acid sequence of the VH of P1-068748 and (ii) the amino acid sequence of SEQ ID NO: 182, and a light chain comprising the light chain amino acid sequence of P1-068748;

(dd) a heavy chain comprising (i) the amino acid sequence of the VH of P1-068750 and (ii) the amino acid sequence of SEQ ID NO: 182, and a light chain comprising the light chain amino acid sequence of P1-068750;

(ee) a heavy chain comprising (i) the amino acid sequence of the VH of P1-068752 and (ii) the amino acid sequence of SEQ ID NO: 182, and a light chain comprising the light chain amino acid sequence of P1-068752;

(ff) a heavy chain comprising (i) the amino acid sequence of the VH of P1-068754 and (ii) the amino acid sequence of SEQ ID NO: 182, and a light chain comprising the light chain amino acid sequence of P1-068754;

(gg) a heavy chain comprising (i) the amino acid sequence of the VH of P1-068761_E55A and (ii) the amino acid sequence of SEQ ID NO: 182, and a light chain comprising the light chain amino acid sequence of P1-068761_E55A;

(hh) a heavy chain comprising (i) the amino acid sequence of the VH of P1-068761_H100G and (ii) the amino acid sequence of SEQ ID NO: 182, and a light chain comprising the light chain amino acid sequence of P1-068761_H100G;

(ii) a heavy chain comprising (i) the amino acid sequence of the VH of P1-068761_E56N and (ii) the amino acid sequence of SEQ ID NO: 182, and a light chain comprising the light chain amino acid sequence of P1-068761_E56N;

(jj) a heavy chain comprising (i) the amino acid sequence of the VH of P1-068761_E55A_E56N and (ii) the amino acid sequence of SEQ ID NO: 182, and a light chain comprising the light chain amino acid sequence of P1-068761_E55A_E56N;

(kk) a heavy chain comprising (i) the amino acid sequence of the VH of P1-068761_E30D and (ii) the amino acid sequence of SEQ ID NO: 182, and a light chain comprising the light chain amino acid sequence of P1-068761_E30D;

(ll) a heavy chain comprising (i) the amino acid sequence of the VH of P1-068761_E30D_E55A and (ii) the amino acid sequence of SEQ ID NO: 182, and a light chain comprising the light chain amino acid sequence of P1-068761_E30D_E55A;

(mm) a heavy chain comprising (i) the amino acid sequence of the VH of P1-068761_E56N_H100G and (ii) the amino acid sequence of SEQ ID NO: 182, and a light chain comprising the light chain amino acid sequence of P1-068761_E56N_H100G;

(nn) a heavy chain comprising (i) the amino acid sequence of the VH of P1-068761_E30D_H100G and (ii) the amino acid sequence of SEQ ID NO: 182, and a light chain comprising the light chain amino acid sequence of P1-068761_E30D_H100G;

(oo) a heavy chain comprising (i) the amino acid sequence of the VH of P1-068761_E30D_E56N and (ii) the amino acid sequence of SEQ ID NO: 182, and a light chain comprising the light chain amino acid sequence of P1-068761_E30D_E56N;

(pp) a heavy chain comprising (i) the amino acid sequence of the VH of P1-068761_E100fF and (ii) the amino acid sequence of SEQ ID NO: 182, and a light chain comprising the light chain amino acid sequence of P1-068761_E100fF;

(qq) a heavy chain comprising (i) the amino acid sequence of the VH of P1-068761_E55A_E100fF and (ii) the amino acid sequence of SEQ ID NO: 182, and a light chain comprising the light chain amino acid sequence of P1-068761_E55A_E100fF;

(rr) a heavy chain comprising (i) the amino acid sequence of the VH of P1-068761_H100G_E100fF and (ii) the amino acid sequence of SEQ ID NO: 182, and a light chain comprising the light chain amino acid sequence of P1-068761_H100G_E100fF;

(ss) a heavy chain comprising (i) the amino acid sequence of the VH of P1-068761_E30D_E100fF and (ii) the amino acid sequence of SEQ ID NO: 182, and a light chain comprising the light chain amino acid sequence of P1-068761_E30D_E100fF;

(tt) a heavy chain comprising (i) the amino acid sequence of the VH of P1-068761_E56N_E100fF and (ii) the amino acid sequence of SEQ ID NO: 182, and a light chain comprising the light chain amino acid sequence of P1-068761_E56N_E100fF;

(uu) a heavy chain comprising (i) the amino acid sequence of the VH of P1-068761_E32Y and (ii) the amino acid sequence of SEQ ID NO: 182, and a light chain comprising the light chain amino acid sequence of P1-068761_E32Y;

(vv) a heavy chain comprising (i) the amino acid sequence of the VH of P1-068761_E32Y_E55A and (ii) the amino acid sequence of SEQ ID NO: 182, and a light chain comprising the light chain amino acid sequence of P1-068761_E32Y_E55A;

(ww) a heavy chain comprising (i) the amino acid sequence of the VH of P1-068761_E32Y_E56N and (ii) the amino acid sequence of SEQ ID NO: 182, and a light chain comprising the light chain amino acid sequence of P1-068761_E32Y_E56N;

(xx) a heavy chain comprising (i) the amino acid sequence of the VH of P1-068761_E30D_E32Y and (ii) the amino acid sequence of SEQ ID NO: 182, and a light chain comprising the light chain amino acid sequence of P1-068761_E30D_E32Y;

(yy) a heavy chain comprising (i) the amino acid sequence of the VH of P1-068761_E32Y_H100G and (ii) the amino acid sequence of SEQ ID NO: 182, and a light chain comprising the light chain amino acid sequence of P1-068761_E32Y_H100G;

(zz) a heavy chain comprising (i) the amino acid sequence of the VH of P1-068761_E32Y_E100fF and (ii) the amino acid sequence of SEQ ID NO: 182, and a light chain comprising the light chain amino acid sequence of P1-068761_E32Y_E100fF;

(aaa) a heavy chain comprising (i) the amino acid sequence of the VH of P1-068767_D52N_D102V and (ii) the amino acid sequence of SEQ ID NO: 182, and a light chain comprising the light chain amino acid sequence of P1-068767_D52N_D102V;

(bbb) a heavy chain comprising (i) the amino acid sequence of the VH of P1-068767_D52N and (ii) the amino acid sequence of SEQ ID NO: 182, and a light chain comprising the light chain amino acid sequence of P1-068767_D52N;

(ccc) a heavy chain comprising (i) the amino acid sequence of the VH of P1-068767_D52N_E55A and (ii) the amino acid sequence of SEQ ID NO: 182, and a light chain comprising the light chain amino acid sequence of P1-068767_D52N_E55A;

(ddd) a heavy chain comprising (i) the amino acid sequence of the VH of P1-068767_E55A_D102V and (ii) the amino acid sequence of SEQ ID NO: 182, and a light chain comprising the light chain amino acid sequence of P1-068767_E55A_D102V;

(eee) a heavy chain comprising (i) the amino acid sequence of the VH of P1-068767_D102V and (ii) the amino acid sequence of SEQ ID NO: 182, and a light chain comprising the light chain amino acid sequence of P1-068767_D102V;

(fff) a heavy chain comprising (i) the amino acid sequence of the VH of P1-068767_E55A and (ii) the amino acid sequence of SEQ ID NO: 182, and a light chain comprising the light chain amino acid sequence of P1-068767_E55A;

(ggg) a heavy chain comprising (i) the amino acid sequence of the VH of P1-068767_E30D_D52N and (ii) the amino acid sequence of SEQ ID NO: 182, and a light chain comprising the light chain amino acid sequence of P1-068767_E30D_D52N;

(hhh) a heavy chain comprising (i) the amino acid sequence of the VH of P1-068767_E30D_D102V and (ii) the amino acid sequence of SEQ ID NO: 182, and a light chain comprising the light chain amino acid sequence of P1-068767_E30D_D102V;

(iii) a heavy chain comprising (i) the amino acid sequence of the VH of P1-068767_E30D and (ii) the amino acid sequence of SEQ ID NO: 182, and a light chain comprising the light chain amino acid sequence of P1-068767_E30D;

(jjj) a heavy chain comprising (i) the amino acid sequence of the VH of P1-068767_E30D_E55A and (ii) the amino acid sequence of SEQ ID NO: 182, and a light chain comprising the light chain amino acid sequence of P1-068767_E30D_E55A;

(kkk) a heavy chain comprising (i) the amino acid sequence of the VH of P1-068767_E100fF_D102V and (ii) the amino acid sequence of SEQ ID NO: 182, and a light chain comprising the light chain amino acid sequence of P1-068767_E100fF_D102V;

(lll) a heavy chain comprising (i) the amino acid sequence of the VH of P1-068767_E55A_E100fF and (ii) the amino acid sequence of SEQ ID NO: 182, and a light chain comprising the light chain amino acid sequence of P1-068767_E55A_E100fF;

(mmm) a heavy chain comprising (i) the amino acid sequence of the VH of P1-068767_D52N_E100fF and (ii) the amino acid sequence of SEQ ID NO: 182, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 182, and a light chain comprising the light chain amino acid sequence of P1-068767_E100fF;

(ooo) a heavy chain comprising (i) the amino acid sequence of the VH of P1-068767_E30D_E100fF and (ii) the amino acid sequence of SEQ ID NO: 182, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 182, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 182, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 182, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 182, and a light chain comprising the light chain amino acid sequence of P1-061029_Y32E;

(ttt) a heavy chain comprising (i) the amino acid sequence of the VH of P1-061029_Y32E_F100fE and (ii) the amino acid sequence of SEQ ID NO: 182, and a light chain comprising the light chain amino acid sequence of P1-061029_Y32E_F100fE;

(uuu) a heavy chain comprising (i) the amino acid sequence of the VH of P1-068744_E31S and (ii) the amino acid sequence of SEQ ID NO: 182, and a light chain comprising the light chain amino acid sequence of P1-068744_E31S;

(vvv) a heavy chain comprising (i) the amino acid sequence of the VH of P1-068744_H50I and (ii) the amino acid sequence of SEQ ID NO: 182, and a light chain comprising the light chain amino acid sequence of P1-068744_H50I;

(www) a heavy chain comprising (i) the amino acid sequence of the VH of P1-068744_E59Y and (ii) the amino acid sequence of SEQ ID NO: 182, and a light chain comprising the light chain amino acid sequence of P1-068744_E59Y;

(xxx) a heavy chain comprising (i) the amino acid sequence of the VH of P1-068744_E100S and (ii) the amino acid sequence of SEQ ID NO: 182, and a light chain comprising the light chain amino acid sequence of P1-068744_E100S;

(yyy) a heavy chain comprising (i) the amino acid sequence of the VH of P1-068744_E102Y and (ii) the amino acid sequence of SEQ ID NO: 182, and a light chain comprising the light chain amino acid sequence of P1-068744_E102Y;

(zzz) a heavy chain comprising (i) the amino acid sequence of the VH of P1-068744_E31S_H50I and (ii) the amino acid sequence of SEQ ID NO: 182, and a light chain comprising the light chain amino acid sequence of P1-068744_E31S_H50I;

(aaaa) a heavy chain comprising (i) the amino acid sequence of the VH of P1-068744_H50I_E59Y and (ii) the amino acid sequence of SEQ ID NO: 182, and a light chain comprising the light chain amino acid sequence of P1-068744_H50I_E59Y;

(bbbb) a heavy chain comprising (i) the amino acid sequence of the VH of P1-068744_E59Y_E100S and (ii) the amino acid sequence of SEQ ID NO: 182, and a light chain comprising the light chain amino acid sequence of P1-068744_E5;9Y_E100S;

(cccc) a heavy chain comprising (i) the amino acid sequence of the VH of P1-068744_E100S_E102Y and (ii) the amino acid sequence of SEQ ID NO: 182, and a light chain comprising the light chain amino acid sequence of P1-068744_E100S_E102Y;

(dddd) a heavy chain comprising (i) the amino acid sequence of the VH of P1-068744_E31S_E102Y and (ii) the amino acid sequence of SEQ ID NO: 182, and a light chain comprising the light chain amino acid sequence of P1-068744_E31S_E102Y;

(eeee) a heavy chain comprising (i) the amino acid sequence of the VH of P1-068744_E31S_E59Y and (ii) the amino acid sequence of SEQ ID NO: 182, and a light chain comprising the light chain amino acid sequence of P1-068744_E31S_E59Y;

(ffff) a heavy chain comprising (i) the amino acid sequence of the VH of P1-068744_E31S_E100S and (ii) the amino acid sequence of SEQ ID NO: 182, and a light chain comprising the light chain amino acid sequence of P1-068744_E31S_E100S;

(gggg) a heavy chain comprising (i) the amino acid sequence of the VH of P1-068744_H50I_E100S and (ii) the amino acid sequence of SEQ ID NO: 182, and a light chain comprising the light chain amino acid sequence of P1-068744_H50I_E100S;

(hhhh) a heavy chain comprising (i) the amino acid sequence of the VH of P1-068744_H50I_E102Y and (ii) the amino acid sequence of SEQ ID NO: 182, and a light chain comprising the light chain amino acid sequence of P1-068744_H50I_E102Y;

(iiii) a heavy chain comprising (i) the amino acid sequence of the VH of P1-068744_E59Y_E102Y and (ii) the amino acid sequence of SEQ ID NO: 182, and a VL and a light chain comprising the light chain amino acid sequence of P1-068744_E59Y_E102Y;

(jjjj) a heavy chain comprising (i) the amino acid sequence of the VH of P1-068748_H31S and (ii) the amino acid sequence of SEQ ID NO: 182, and a light chain comprising the light chain amino acid sequence of P1-068748_H31S;

(kkkk) a heavy chain comprising (i) the amino acid sequence of the VH of P1-068748_H32Y and (ii) the amino acid sequence of SEQ ID NO: 182, and a light chain comprising the light chain amino acid sequence of P1-068748_H32Y;

(llll) a heavy chain comprising (i) the amino acid sequence of the VH of P1-068748_D57K and (ii) the amino acid sequence of SEQ ID NO: 182, and a light chain comprising the light chain amino acid sequence of P1-068748_D57K;

(mmmm) a heavy chain comprising (i) the amino acid sequence of the VH of P1-068748_D58Y and (ii) the amino acid sequence of SEQ ID NO: 182, and a light chain comprising the light chain amino acid sequence of P1-068748_D58Y;

(nnnn) a heavy chain comprising (i) the amino acid sequence of the VH of P1-068748_D100S and (ii) the amino acid sequence of SEQ ID NO: 182, and a light chain comprising the light chain amino acid sequence of P1-068748_D100S;

(oooo) a heavy chain comprising (i) the amino acid sequence of the VH of P1-068748_H31S_H32Y and (ii) the amino acid sequence of SEQ ID NO: 182, and a light chain comprising the light chain amino acid sequence of P1-068748_H31S_H32Y;

(pppp) a heavy chain comprising (i) the amino acid sequence of the VH of P1-068748_H32Y_D57K and (ii) the amino acid sequence of SEQ ID NO: 182, and a light chain comprising the light chain amino acid sequence of P1-068748_H32Y_D57K;

(qqqq) a heavy chain comprising (i) the amino acid sequence of the VH of P1-068748_D57K_D58Y and (ii) the amino acid sequence of SEQ ID NO: 182, and a light chain comprising the light chain amino acid sequence of P1-068748_D57K_D58Y;

(rrrr) a heavy chain comprising (i) the amino acid sequence of the VH of P1-068748_D58Y_D100S and (ii) the amino acid sequence of SEQ ID NO: 182, and a light chain comprising the light chain amino acid sequence of P1-068748_D58Y_D100S;

(ssss) a heavy chain comprising (i) the amino acid sequence of the VH of P1-068748_H31S_D57K and (ii) the amino acid sequence of SEQ ID NO: 182, and a light chain comprising the light chain amino acid sequence of P1-068748_H31S_D57K;

(tttt) a heavy chain comprising (i) the amino acid sequence of the VH of P1-068748_H31S_D58Y and (ii) the amino acid sequence of SEQ ID NO: 182, and a light chain comprising the light chain amino acid sequence of P1-068748_H31S_D58Y;

(uuuu) a heavy chain comprising (i) the amino acid sequence of the VH of P1-068748_H31S_D100S and (ii) the amino acid sequence of SEQ ID NO: 182, and a light chain comprising the light chain amino acid sequence of P1-068748_H31S_D100S;

(vvvv) a heavy chain comprising (i) the amino acid sequence of the VH of P1-068748_H32Y_D58Y and (ii) the amino acid sequence of SEQ ID NO: 182, and a light chain comprising the light chain amino acid sequence of P1-068748_H32Y_D58Y;

(wwww) a heavy chain comprising (i) the amino acid sequence of the VH of P1-068748_H32Y_D100S and (ii) the amino acid sequence of SEQ ID NO: 182, and a light chain comprising the light chain amino acid sequence of P1-068748_H32Y_D100S; or (xxxx) a heavy chain comprising (i) the amino acid sequence of the VH of P1-068748_D57K_D100S and (ii) the amino acid sequence of SEQ ID NO: 182, and a light chain comprising the light chain amino acid sequence of P1-068748_D57K_D100S, optionally wherein the VH in any of (a) or (c) to (ttt) comprises one or both of the K16R and T84A substitutions, and optionally wherein the VL of (b) or (uuu) to (xxxx) comprises a T85V substitution.

In some embodiments, the LC may be as specified in (a) to (ttt) above, but the HC may differ from the sequence of each of the species (a) to ttt) by the presence of 1, 2, 3, 4, or 5 amino acid substitutions, such as 1, 2, 3, 4, or 5 conservative substitutions. In some embodiments, for example, the HC of P1-061029 or one of its progeny may comprise one or both of the K16R and T84A substitutions in the VH region of the HC (P1-061015 and its progeny already have an R at VH position 16 and an A at VH position 84). In some embodiments, the VL of P1-061015 or its progeny may have a T85V substitution.

Certain embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 182, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 182, and a light chain consisting of the light chain amino acid sequence of P1-061015;

(c) a heavy chain consisting of (i) the amino acid sequence of the VH of P1-068757 and (ii) the amino acid sequence of SEQ ID NO: 182, and a light chain consisting of the light chain amino acid sequence of P1-068757;

(d) a heavy chain consisting of (i) the amino acid sequence of the VH of P1-068759 and (ii) the amino acid sequence of SEQ ID NO: 182, and a light chain consisting of the light chain amino acid sequence of P1-068759;

(e) a heavy chain consisting of (i) the amino acid sequence of the VH of P1-068761 and (ii) the amino acid sequence of SEQ ID NO: 182, and a light chain consisting of the light chain amino acid sequence of P1-068761;

(f) a heavy chain consisting of (i) the amino acid sequence of the VH of P1-068763 and (ii) the amino acid sequence of SEQ ID NO: 182, and a light chain consisting of the light chain amino acid sequence of P1-068763;

(g) a heavy chain consisting of (i) the amino acid sequence of the VH of P1-068765 and (ii) the amino acid sequence of SEQ ID NO: 182, and a light chain consisting of the light chain amino acid sequence of P1-068765;

(h) a heavy chain consisting of (i) the amino acid sequence of the VH of P1-068767 and (ii) the amino acid sequence of SEQ ID NO: 182, and a light chain consisting of the light chain amino acid sequence of P1-068767;

(i) a heavy chain consisting of (i) the amino acid sequence of the VH of P1-068769 and (ii) the amino acid sequence of SEQ ID NO: 182, and a light chain consisting of the light chain amino acid sequence of P1-068769;

(j) a heavy chain consisting of (i) the amino acid sequence of the VH of P1-068771 and (ii) the amino acid sequence of SEQ ID NO: 182, and a light chain consisting of the light chain amino acid sequence of P1-068771;

(k) a heavy chain consisting of (i) the amino acid sequence of the VH of P1-068773 and (ii) the amino acid sequence of SEQ ID NO: 182, and a light chain consisting of the light chain amino acid sequence of P1-068773;

(l) a heavy chain consisting of (i) the amino acid sequence of the VH of P1-068775 and (ii) the amino acid sequence of SEQ ID NO: 182, and a light chain consisting of the light chain amino acid sequence of P1-068775;

(m) a heavy chain consisting of (i) the amino acid sequence of the VH of P1-069059 and (ii) the amino acid sequence of SEQ ID NO: 182, and a light chain consisting of the light chain amino acid sequence of P1-069059;

(n) a heavy chain consisting of (i) the amino acid sequence of the VH of P1-069061 and (ii) the amino acid sequence of SEQ ID NO: 182, and a light chain consisting of the light chain amino acid sequence of P1-069061;

(o) a heavy chain consisting of (i) the amino acid sequence of the VH of P1-069063 and (ii) the amino acid sequence of SEQ ID NO: 182, and a light chain consisting of the light chain amino acid sequence of P1-069063;

(p) a heavy chain consisting of (i) the amino acid sequence of the VH of P1-069065 and (ii) the amino acid sequence of SEQ ID NO: 182, and a light chain consisting of the light chain amino acid sequence of P1-069065;

(q) a heavy chain consisting of (i) the amino acid sequence of the VH of P1-069067 and (ii) the amino acid sequence of SEQ ID NO: 182, and a light chain consisting of the light chain amino acid sequence of P1-069067;

(r) a heavy chain consisting of (i) the amino acid sequence of the VH of P1-069069 and (ii) the amino acid sequence of SEQ ID NO: 182, and a light chain consisting of the light chain amino acid sequence of P1-069069;

(s) a heavy chain consisting of (i) the amino acid sequence of the VH of P1-069071 and (ii) the amino acid sequence of SEQ ID NO: 182, and a light chain consisting of the light chain amino acid sequence of P1-069071;

(t) a heavy chain consisting of (i) the amino acid sequence of the VH of P1-069073 and (ii) the amino acid sequence of SEQ ID NO: 182, and a light chain consisting of the light chain amino acid sequence of P1-069073;

(u) a heavy chain consisting of (i) the amino acid sequence of the VH of P1-069075 and (ii) the amino acid sequence of SEQ ID NO: 182, and a light chain consisting of the light chain amino acid sequence of P1-069075;

(v) a heavy chain consisting of (i) the amino acid sequence of the VH of P1-069077 and (ii) the amino acid sequence of SEQ ID NO: 182, and a light chain consisting of the light chain amino acid sequence of P1-069077;

(w) a heavy chain consisting of (i) the amino acid sequence of the VH of P1-068736 and (ii) the amino acid sequence of SEQ ID NO: 182, and a light chain consisting of the light chain amino acid sequence of P1-068736;

(x) a heavy chain consisting of (i) the amino acid sequence of the VH of P1-068738 and (ii) the amino acid sequence of SEQ ID NO: 182, and a light chain consisting of the light chain amino acid sequence of P1-068738;

(y) a heavy chain consisting of (i) the amino acid sequence of the VH of P1-068740 and (ii) the amino acid sequence of SEQ ID NO: 182, and a light chain consisting of the light chain amino acid sequence of P1-068740;

(z) a heavy chain consisting of (i) the amino acid sequence of the VH of P1-068742 and (ii) the amino acid sequence of SEQ ID NO: 182, and a light chain consisting of the light chain amino acid sequence of P1-068742;

(aa) a heavy chain consisting of (i) the amino acid sequence of the VH of P1-068744 and (ii) the amino acid sequence of SEQ ID NO: 182, and a light chain consisting of the light chain amino acid sequence of P1-068744;

(bb) a heavy chain consisting of the amino acid sequence of the VH of P1-068746 and (ii) the amino acid sequence of SEQ ID NO: 182, and a light chain consisting of the light chain amino acid sequence of P1-068746;

(cc) a heavy chain consisting of (i) the amino acid sequence of the VH of P1-068748 and (ii) the amino acid sequence of SEQ ID NO: 182, and a light chain consisting of the light chain amino acid sequence of P1-068748;

(dd) a heavy chain consisting of (i) the amino acid sequence of the VH of P1-068750 and (ii) the amino acid sequence of SEQ ID NO: 182, and a light chain consisting of the light chain amino acid sequence of P1-068750;

(ee) a heavy chain consisting of (i) the amino acid sequence of the VH of P1-068752 and (ii) the amino acid sequence of SEQ ID NO: 182, and a light chain consisting of the light chain amino acid sequence of P1-068752;

(ff) a heavy chain consisting of (i) the amino acid sequence of the VH of P1-068754 and (ii) the amino acid sequence of SEQ ID NO: 182, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 182, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 182, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 182, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 182, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 182, and a light chain consisting of the light chain amino acid sequence of P1-068761_E30D;

(11) a heavy chain consisting of (i) the amino acid sequence of the VH of P1-068761_E30D_E55A and (ii) the amino acid sequence of SEQ ID NO: 182, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 182, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 182, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 182, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 182, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 182, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 182, and a light chain consisting of the light chain amino acid sequence of P1-068761_H100G_E100fF;

(ss) a heavy chain consisting of (i) the amino acid sequence of the VH of P1-068761_E30D_E100fF and (ii) the amino acid sequence of SEQ ID NO: 182, and a light chain consisting of the light chain amino acid sequence of P1-098761_E30D_E100fF;

(tt) a heavy chain consisting of (i) the amino acid sequence of the VH of P1-068761_E56N_E100fF and (ii) the amino acid sequence of SEQ ID NO: 182, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 182, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 182, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 182, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 182, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 182, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 182, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 182, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 182, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 182, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 182, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 182, and a light chain consisting of the light chain amino acid sequence of P1-068767_D102V;

(fff) a heavy chain consisting of (i) the amino acid sequence of the VH of P1-068767_E55A and (ii) the amino acid sequence of SEQ ID NO: 182, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 182, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 182, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 182, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 182, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 182, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 182, and a light chain consisting of the light chain amino acid sequence of P1-068767_E55A_E100fF;

(mmm) a heavy chain consisting of (i) the amino acid sequence of the VH of P1-068767_D52N_E100fF and (ii) the amino acid sequence of SEQ ID NO: 182, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 182, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 182, and a light chain consisting of the light chain amino acid sequence of P1-068767_E30D_E100fF;

(ppp) a heavy chain consisting of (i) the amino acid sequence of the VH of P1-061029_F100fE_V102D and (ii) the amino acid sequence of SEQ ID NO: 182, and a light chain consisting of the light chain amino acid sequence of P1-061029_F100fE_V102D;

(qqq) a heavy chain consisting of (i) the amino acid sequence of the VH of P1-061029_F100fE and (ii) the amino acid sequence of SEQ ID NO: 182, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 182, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 182, and a light chain consisting of the light chain amino acid sequence of P1-061029_Y32E;

(ttt) a heavy chain consisting of (i) the amino acid sequence of the VH of P1-061029_Y32E_F100fE and (ii) the amino acid sequence of SEQ ID NO: 182, and a light chain consisting of the light chain amino acid sequence of P1-061029_Y32E_F100fE;

(uuu) a heavy chain consisting of (i) the amino acid sequence of the VH of P1-068744_E31S and (ii) the amino acid sequence of SEQ ID NO: 182, and a light chain consisting of the light chain amino acid sequence of P1-068744_E31S;

(vvv) a heavy chain consisting of (i) the amino acid sequence of the VH of P1-068744_H50I and (ii) the amino acid sequence of SEQ ID NO: 182, and a light chain consisting of the light chain amino acid sequence of P1-068744_H50I;

(www) a heavy chain consisting of (i) the amino acid sequence of the VH of P1-068744_E59Y and (ii) the amino acid sequence of SEQ ID NO: 182, and a light chain consisting of the light chain amino acid sequence of P1-068744_E59Y;

(xxx) a heavy chain consisting of (i) the amino acid sequence of the VH of P1-068744_E100S and (ii) the amino acid sequence of SEQ ID NO: 182, and a light chain consisting of the light chain amino acid sequence of P1-068744_E100S;

(yyy) a heavy chain consisting of (i) the amino acid sequence of the VH of P1-068744_E102Y and (ii) the amino acid sequence of SEQ ID NO: 182, and a light chain consisting of the light chain amino acid sequence of P1-068744_E102Y;

(zzz) a heavy chain consisting of (i) the amino acid sequence of the VH of P1-068744_E31S_H50I and (ii) the amino acid sequence of SEQ ID NO: 182, and a light chain consisting of the light chain amino acid sequence of P1-068744_E31S_H50I;

(aaaa) a heavy chain consisting of (i) the amino acid sequence of the VH of P1-068744_H50I_E59Y and (ii) the amino acid sequence of SEQ ID NO: 182, and a light chain consisting of the light chain amino acid sequence of P1-068744_H50I_E59Y;

(bbbb) a heavy chain consisting of (i) the amino acid sequence of the VH of P1-068744_E59Y_E100S and (ii) the amino acid sequence of SEQ ID NO: 182, and a light chain consisting of the light chain amino acid sequence of P1-068744_E5;9Y_E100S;

(cccc) a heavy chain consisting of (i) the amino acid sequence of the VH of P1-068744_E100S_E102Y and (ii) the amino acid sequence of SEQ ID NO: 182, and a light chain consisting of the light chain amino acid sequence of P1-068744_E100S_E102Y;

(dddd) a heavy chain consisting of (i) the amino acid sequence of the VH of P1-068744_E31S_E102Y and (ii) the amino acid sequence of SEQ ID NO: 182, and a light chain consisting of the light chain amino acid sequence of P1-068744_E31S_E102Y;

(eeee) a heavy chain consisting of (i) the amino acid sequence of the VH of P1-068744_E31S_E59Y and (ii) the amino acid sequence of SEQ ID NO: 182, and a light chain consisting of the light chain amino acid sequence of P1-068744_E31S_E59Y;

(ffff) a heavy chain consisting of (i) the amino acid sequence of the VH of P1-068744_E31S_E100S and (ii) the amino acid sequence of SEQ ID NO: 182, and a light chain consisting of the light chain amino acid sequence of P1-068744_E31S_E100S;

(gggg) a heavy chain consisting of (i) the amino acid sequence of the VH of P1-068744_H50I_E100S and (ii) the amino acid sequence of SEQ ID NO: 182, and a light chain consisting of the light chain amino acid sequence of P1-068744_H50I_E100S;

(hhhh) a heavy chain consisting of (i) the amino acid sequence of the VH of P1-068744_H50I_E102Y and (ii) the amino acid sequence of SEQ ID NO: 182, and a light chain consisting of the light chain amino acid sequence of P1-068744_H50I_E102Y;

(iiii) a heavy chain consisting of (i) the amino acid sequence of the VH of P1-068744_E59Y_E102Y and (ii) the amino acid sequence of SEQ ID NO: 182, and a VL and a light chain consisting of the light chain amino acid sequence of P1-068744_E59Y_E102Y;

(jjjj) a heavy chain consisting of (i) the amino acid sequence of the VH of P1-068748_H31S and (ii) the amino acid sequence of SEQ ID NO: 182, and a light chain consisting of the light chain amino acid sequence of P1-068748_H31S;

(kkkk) a heavy chain consisting of (i) the amino acid sequence of the VH of P1-068748_H32Y and (ii) the amino acid sequence of SEQ ID NO: 182, and a light chain consisting of the light chain amino acid sequence of P1-068748_H32Y;

(1111) a heavy chain consisting of (i) the amino acid sequence of the VH of P1-068748_D57K and (ii) the amino acid sequence of SEQ ID NO: 182, and a light chain consisting of the light chain amino acid sequence of P1-068748_D57K;

(mmmm) a heavy chain consisting of (i) the amino acid sequence of the VH of P1-068748_D58Y and (ii) the amino acid sequence of SEQ ID NO: 182, and a light chain consisting of the light chain amino acid sequence of P1-068748_D58Y;

(nnnn) a heavy chain consisting of (i) the amino acid sequence of the VH of P1-068748_D100S and (ii) the amino acid sequence of SEQ ID NO: 182, and a light chain consisting of the light chain amino acid sequence of P1-068748_D100S;

(oooo) a heavy chain consisting of (i) the amino acid sequence of the VH of P1-068748_H31S_H32Y and (ii) the amino acid sequence of SEQ ID NO: 182, and a light chain consisting of the light chain amino acid sequence of P1-068748_H31S_H32Y;

(pppp) a heavy chain consisting of (i) the amino acid sequence of the VH of P1-068748_H32Y_D57K and (ii) the amino acid sequence of SEQ ID NO: 182, and a light chain consisting of the light chain amino acid sequence of P1-068748_H32Y_D57K;

(qqqq) a heavy chain consisting of (i) the amino acid sequence of the VH of P1-068748_D57K_D58Y and (ii) the amino acid sequence of SEQ ID NO: 182, and a light chain consisting of the light chain amino acid sequence of P1-068748_D57K_D58Y;

(rrrr) a heavy chain consisting of (i) the amino acid sequence of the VH of P1-068748_D58Y_D100S and (ii) the amino acid sequence of SEQ ID NO: 182, and a light chain consisting of the light chain amino acid sequence of P1-068748_D58Y_D100S;

(ssss) a heavy chain consisting of (i) the amino acid sequence of the VH of P1-068748_H31S_D57K and (ii) the amino acid sequence of SEQ ID NO: 182, and a light chain consisting of the light chain amino acid sequence of P1-068748_H31S_D57K;

(tttt) a heavy chain consisting of (i) the amino acid sequence of the VH of P1-068748_H31S_D58Y and (ii) the amino acid sequence of SEQ ID NO: 182, and a light chain consisting of the light chain amino acid sequence of P1-068748_H31S_D58Y;

(uuuu) a heavy chain consisting of (i) the amino acid sequence of the VH of P1-068748_H31S_D100S and (ii) the amino acid sequence of SEQ ID NO: 182, and a light chain consisting of the light chain amino acid sequence of P1-068748_H31S_D100S;

(vvvv) a heavy chain consisting of (i) the amino acid sequence of the VH of P1-068748_H32Y_D58Y and (ii) the amino acid sequence of SEQ ID NO: 182, and a light chain consisting of the light chain amino acid sequence of P1-068748_H32Y_D58Y;

(wwww) a heavy chain consisting of (i) the amino acid sequence of the VH of P1-068748_H32Y_D100S and (ii) the amino acid sequence of SEQ ID NO: 182, and a light chain consisting of the light chain amino acid sequence of P1-068748_H32Y_D100S; or (xxxx) a heavy chain consisting of (i) the amino acid sequence of the VH of P1-068748_D57K_D100S and (ii) the amino acid sequence of SEQ ID NO: 182, and a light chain consisting of the light chain amino acid sequence of P1-068748_D57K_D100S, wherein the C-terminal amino acid of VH and the N-terminal amino acid of SEQ ID NO: 182 form a peptidic bond; and optionally wherein the VH in any of (a) or (c) to (ttt) comprises one or both of the K16R and T84A substitutions, and optionally wherein the VL of any of (b) or (uuu) to (xxxx) comprises a T85V substitution.

In some embodiments, the disclosure contemplates anti-VISTA mAbs comprising:

a heavy chain consisting of the amino acid sequences of (i) a VH of (a) to (ttt) listed above, (ii) SEQ ID NO: 182, and (iii) a Lys residue, wherein the C-terminal amino acid of VH and the N-terminal amino acid of SEQ ID NO: 182 form a peptidic bond and wherein the C-terminal amino acid of SEQ ID NO: 182 is joined to the N-terminal of the Lys; and a light chain consisting of the light chain amino acid sequence of (a) to (xxxx) listed above;

wherein the VH and light chain amino acid sequences are chosen from the same antibody species from among (a) to (xxxx) listed above.

Certain embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 183, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 183, and a light chain comprising the light chain amino acid sequence of P1-061015;

(c) a heavy chain comprising (i) the amino acid sequence of the VH of P1-068757 and (ii) the amino acid sequence of SEQ ID NO: 183, and a light chain comprising the light chain amino acid sequence of P1-068757;

(d) a heavy chain comprising (i) the amino acid sequence of the VH of P1-068759 and (ii) the amino acid sequence of SEQ ID NO: 183, and a light chain comprising the light chain amino acid sequence of P1-068759;

(e) a heavy chain comprising (i) the amino acid sequence of the VH of P1-068761 and (ii) the amino acid sequence of SEQ ID NO: 183, and a light chain comprising the light chain amino acid sequence of P1-068761;

(f) a heavy chain comprising (i) the amino acid sequence of the VH of P1-068763 and (ii) the amino acid sequence of SEQ ID NO: 183, and a light chain comprising the light chain amino acid sequence of P1-068763;

(g) a heavy chain comprising (i) the amino acid sequence of the VH of P1-068765 and (ii) the amino acid sequence of SEQ ID NO: 183, and a light chain comprising the light chain amino acid sequence of P1-068765;

(h) a heavy chain comprising (i) the amino acid sequence of the VH of P1-068767 and (ii) the amino acid sequence of SEQ ID NO: 183, and a light chain comprising the light chain amino acid sequence of P1-068767;

(i) a heavy chain comprising (i) the amino acid sequence of the VH of P1-068769 and (ii) the amino acid sequence of SEQ ID NO: 183, and a light chain comprising the light chain amino acid sequence of P1-068769;

(j) a heavy chain comprising (i) the amino acid sequence of the VH of P1-068771 and (ii) the amino acid sequence of SEQ ID NO: 183, and a light chain comprising the light chain amino acid sequence of P1-068771;

(k) a heavy chain comprising (i) the amino acid sequence of the VH of P1-068773 and (ii) the amino acid sequence of SEQ ID NO: 183, and a light chain comprising the light chain amino acid sequence of P1-068773;

(l) a heavy chain comprising (i) the amino acid sequence of the VH of P1-068775 and (ii) the amino acid sequence of SEQ ID NO: 183, and a light chain comprising the light chain amino acid sequence of P1-068775;

(m) a heavy chain comprising (i) the amino acid sequence of the VH of P1-069059 and (ii) the amino acid sequence of SEQ ID NO: 183, and a light chain comprising the light chain amino acid sequence of P1-069059;

(n) a heavy chain comprising (i) the amino acid sequence of the VH of P1-069061 and (ii) the amino acid sequence of SEQ ID NO: 183, and a light chain comprising the light chain amino acid sequence of P1-069061;

(o) a heavy chain comprising (i) the amino acid sequence of the VH of P1-069063 and (ii) the amino acid sequence of SEQ ID NO: 183, and a light chain comprising the light chain amino acid sequence of P1-069063;

(p) a heavy chain comprising (i) the amino acid sequence of the VH of P1-069065 and (ii) the amino acid sequence of SEQ ID NO: 183, and a light chain comprising the light chain amino acid sequence of P1-069065;

(q) a heavy chain comprising (i) the amino acid sequence of the VH of P1-069067 and (ii) the amino acid sequence of SEQ ID NO: 183, and a light chain comprising the light chain amino acid sequence of P1-069067;

(r) a heavy chain comprising (i) the amino acid sequence of the VH of P1-069069 and (ii) the amino acid sequence of SEQ ID NO: 183, and a light chain comprising the light chain amino acid sequence of P1-069069;

(s) a heavy chain comprising (i) the amino acid sequence of the VH of P1-069071 and (ii) the amino acid sequence of SEQ ID NO: 183, and a light chain comprising the light chain amino acid sequence of P1-069071;

(t) a heavy chain comprising (i) the amino acid sequence of the VH of P1-069073 and (ii) the amino acid sequence of SEQ ID NO: 183, and a light chain comprising the light chain amino acid sequence of P1-069073;

(u) a heavy chain comprising (i) the amino acid sequence of the VH of P1-069075 and (ii) the amino acid sequence of SEQ ID NO: 183, and a light chain comprising the light chain amino acid sequence of P1-069075;

(v) a heavy chain comprising (i) the amino acid sequence of the VH of P1-069077 and (ii) the amino acid sequence of SEQ ID NO: 183, and a light chain comprising the light chain amino acid sequence of P1-069077;

(w) a heavy chain comprising (i) the amino acid sequence of the VH of P1-068736 and (ii) the amino acid sequence of SEQ ID NO: 183, and a light chain comprising the light chain amino acid sequence of P1-068736;

(x) a heavy chain comprising (i) the amino acid sequence of the VH of P1-068738 and (ii) the amino acid sequence of SEQ ID NO: 183, and a light chain comprising the light chain amino acid sequence of P1-068738;

(y) a heavy chain comprising (i) the amino acid sequence of the VH of P1-068740 and (ii) the amino acid sequence of SEQ ID NO: 183, and a light chain comprising the light chain amino acid sequence of P1-068740;

(z) a heavy chain comprising (i) the amino acid sequence of the VH of P1-068742 and (ii) the amino acid sequence of SEQ ID NO: 183, and a light chain comprising the light chain amino acid sequence of P1-068742;

(aa) a heavy chain comprising (i) the amino acid sequence of the VH of P1-068744 and (ii) the amino acid sequence of SEQ ID NO: 183, and a light chain comprising the light chain amino acid sequence of P1-068744;

(bb) a heavy chain comprising the amino acid sequence of the VH of P1-068746 and (ii) the amino acid sequence of SEQ ID NO: 183, and a light chain comprising the light chain amino acid sequence of P1-068746;

(cc) a heavy chain comprising (i) the amino acid sequence of the VH of P1-068748 and (ii) the amino acid sequence of SEQ ID NO: 183, and a light chain comprising the light chain amino acid sequence of P1-068748;

(dd) a heavy chain comprising (i) the amino acid sequence of the VH of P1-068750 and (ii) the amino acid sequence of SEQ ID NO: 183, and a light chain comprising the light chain amino acid sequence of P1-068750;

(ee) a heavy chain comprising (i) the amino acid sequence of the VH of P1-068752 and (ii) the amino acid sequence of SEQ ID NO: 183, and a light chain comprising the light chain amino acid sequence of P1-068752;

(ff) a heavy chain comprising (i) the amino acid sequence of the VH of P1-068754 and (ii) the amino acid sequence of SEQ ID NO: 183, and a light chain comprising the light chain amino acid sequence of P1-068754;

(gg) a heavy chain comprising (i) the amino acid sequence of the VH of P1-068761_E55A and (ii) the amino acid sequence of SEQ ID NO: 183, and a light chain comprising the light chain amino acid sequence of P1-068761_E55A;

(hh) a heavy chain comprising (i) the amino acid sequence of the VH of P1-068761_H100G and (ii) the amino acid sequence of SEQ ID NO: 183, and a light chain comprising the light chain amino acid sequence of P1-068761_H100G;

(ii) a heavy chain comprising (i) the amino acid sequence of the VH of P1-068761_E56N and (ii) the amino acid sequence of SEQ ID NO: 183, and a light chain comprising the light chain amino acid sequence of P1-068761_E56N;

(jj) a heavy chain comprising (i) the amino acid sequence of the VH of P1-068761_E55A_E56N and (ii) the amino acid sequence of SEQ ID NO: 183, and a light chain comprising the light chain amino acid sequence of P1-068761_E55A_E56N;

(kk) a heavy chain comprising (i) the amino acid sequence of the VH of P1-068761_E30D and (ii) the amino acid sequence of SEQ ID NO: 183, and a light chain comprising the light chain amino acid sequence of P1-068761_E30D;

(ll) a heavy chain comprising (i) the amino acid sequence of the VH of P1-068761_E30D_E55A and (ii) the amino acid sequence of SEQ ID NO: 183, and a light chain comprising the light chain amino acid sequence of P1-068761_E30D_E55A;

(mm) a heavy chain comprising (i) the amino acid sequence of the VH of P1-068761_E56N_H100G and (ii) the amino acid sequence of SEQ ID NO: 183, and a light chain comprising the light chain amino acid sequence of P1-068761_E56N_H100G;

(nn) a heavy chain comprising (i) the amino acid sequence of the VH of P1-068761_E30D_H100G and (ii) the amino acid sequence of SEQ ID NO: 183, and a light chain comprising the light chain amino acid sequence of P1-068761_E30D_H100G;

(oo) a heavy chain comprising (i) the amino acid sequence of the VH of P1-068761_E30D_E56N and (ii) the amino acid sequence of SEQ ID NO: 183, and a light chain comprising the light chain amino acid sequence of P1-068761_E30D_E56N;

(pp) a heavy chain comprising (i) the amino acid sequence of the VH of P1-068761_E100fF and (ii) the amino acid sequence of SEQ ID NO: 183, and a light chain comprising the light chain amino acid sequence of P1-068761_E100fF;

(qq) a heavy chain comprising (i) the amino acid sequence of the VH of P1-068761_E55A_E100fF and (ii) the amino acid sequence of SEQ ID NO: 183, and a light chain comprising the light chain amino acid sequence of P1-068761_E55A_E100fF;

(rr) a heavy chain comprising (i) the amino acid sequence of the VH of P1-068761_H100G_E100fF and (ii) the amino acid sequence of SEQ ID NO: 183, and a light chain comprising the light chain amino acid sequence of P1-068761_H100G_E100fF;

(ss) a heavy chain comprising (i) the amino acid sequence of the VH of P1-068761_E30D_E100fF and (ii) the amino acid sequence of SEQ ID NO: 183, and a light chain comprising the light chain amino acid sequence of P1-068761_E30D_E100fF;

(tt) a heavy chain comprising (i) the amino acid sequence of the VH of P1-068761_E56N_E100fF and (ii) the amino acid sequence of SEQ ID NO: 183, and a light chain comprising the light chain amino acid sequence of P1-068761_E56N_E100fF;

(uu) a heavy chain comprising (i) the amino acid sequence of the VH of P1-068761_E32Y and (ii) the amino acid sequence of SEQ ID NO: 183, and a light chain comprising the light chain amino acid sequence of P1-068761_E32Y;

(vv) a heavy chain comprising (i) the amino acid sequence of the VH of P1-068761_E32Y_E55A and (ii) the amino acid sequence of SEQ ID NO: 183, and a light chain comprising the light chain amino acid sequence of P1-068761_E32Y_E55A;

(ww) a heavy chain comprising (i) the amino acid sequence of the VH of P1-068761_E32Y_E56N and (ii) the amino acid sequence of SEQ ID NO: 183, and a light chain comprising the light chain amino acid sequence of P1-068761_E32Y_E56N;

(xx) a heavy chain comprising (i) the amino acid sequence of the VH of P1-068761_E30D_E32Y and (ii) the amino acid sequence of SEQ ID NO: 183, and a light chain comprising the light chain amino acid sequence of P1-068761_E30D_E32Y;

(yy) a heavy chain comprising (i) the amino acid sequence of the VH of P1-068761_E32Y_H100G and (ii) the amino acid sequence of SEQ ID NO: 183, and a light chain comprising the light chain amino acid sequence of P1-068761_E32Y_H100G;

(zz) a heavy chain comprising (i) the amino acid sequence of the VH of P1-068761_E32Y_E100fF and (ii) the amino acid sequence of SEQ ID NO: 183, and a light chain comprising the light chain amino acid sequence of P1-068761_E32Y_E100fF;

(aaa) a heavy chain comprising (i) the amino acid sequence of the VH of P1-068767_D52N_D102V and (ii) the amino acid sequence of SEQ ID NO: 183, and a light chain comprising the light chain amino acid sequence of P1-068767_D52N_D102V;

(bbb) a heavy chain comprising (i) the amino acid sequence of the VH of P1-068767_D52N and (ii) the amino acid sequence of SEQ ID NO: 183, and a light chain comprising the light chain amino acid sequence of P1-068767_D52N;

(ccc) a heavy chain comprising (i) the amino acid sequence of the VH of P1-068767_D52N_E55A and (ii) the amino acid sequence of SEQ ID NO: 183, and a light chain comprising the light chain amino acid sequence of P1-068767_D52N_E55A;

(ddd) a heavy chain comprising (i) the amino acid sequence of the VH of P1-068767_E55A_D102V and (ii) the amino acid sequence of SEQ ID NO: 183, and a light chain comprising the light chain amino acid sequence of P1-068767_E55A_D102V;

(eee) a heavy chain comprising (i) the amino acid sequence of the VH of P1-068767_D102V and (ii) the amino acid sequence of SEQ ID NO: 183, and a light chain comprising the light chain amino acid sequence of P1-068767_D102V;

(fff) a heavy chain comprising (i) the amino acid sequence of the VH of P1-068767_E55A and (ii) the amino acid sequence of SEQ ID NO: 183, and a light chain comprising the light chain amino acid sequence of P1-068767_E55A;

(ggg) a heavy chain comprising (i) the amino acid sequence of the VH of P1-068767_E30D_D52N and (ii) the amino acid sequence of SEQ ID NO: 183, and a light chain comprising the light chain amino acid sequence of P1-068767_E30D_D52N;

(hhh) a heavy chain comprising (i) the amino acid sequence of the VH of P1-068767_E30D_D102V and (ii) the amino acid sequence of SEQ ID NO: 183, and a light chain comprising the light chain amino acid sequence of P1-068767_E30D_D102V;

(iii) a heavy chain comprising (i) the amino acid sequence of the VH of P1-068767_E30D and (ii) the amino acid sequence of SEQ ID NO: 183, and a light chain comprising the light chain amino acid sequence of P1-068767_E30D;

(jjj) a heavy chain comprising (i) the amino acid sequence of the VH of P1-068767_E30D_E55A and (ii) the amino acid sequence of SEQ ID NO: 183, and a light chain comprising the light chain amino acid sequence of P1-068767_E30D_E55A;

(kkk) a heavy chain comprising (i) the amino acid sequence of the VH of P1-068767_E100fF_D102V and (ii) the amino acid sequence of SEQ ID NO: 183, and a light chain comprising the light chain amino acid sequence of P1-068767_E100fF_D102V;

(lll) a heavy chain comprising (i) the amino acid sequence of the VH of P1-068767_E55A_E100fF and (ii) the amino acid sequence of SEQ ID NO: 183, and a light chain comprising the light chain amino acid sequence of P1-068767_E55A_E100fF;

(mmm) a heavy chain comprising (i) the amino acid sequence of the VH of P1-068767_D52N_E100fF and (ii) the amino acid sequence of SEQ ID NO: 183, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 183, and a light chain comprising the light chain amino acid sequence of P1-068767_E100fF;

(ooo) a heavy chain comprising (i) the amino acid sequence of the VH of P1-068767_E30D_E100fF and (ii) the amino acid sequence of SEQ ID NO: 183, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 183, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 183, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 183, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 183, and a light chain comprising the light chain amino acid sequence of P1-061029_Y32E;

(ttt a heavy chain comprising (i) the amino acid sequence of the VH of P1-061029_Y32E_F100fE and (ii) the amino acid sequence of SEQ ID NO: 183, and a light chain comprising the light chain amino acid sequence of P1-061029_Y32E_F100fE (uuu) a heavy chain comprising (i) the amino acid sequence of the VH of P1-068744_E31S and (ii) the amino acid sequence of SEQ ID NO: 183, and a light chain comprising the light chain amino acid sequence of P1-068744_E31S;

(vvv) a heavy chain comprising (i) the amino acid sequence of the VH of P1-068744_H50I and (ii) the amino acid sequence of SEQ ID NO: 183, and a light chain comprising the light chain amino acid sequence of P1-068744_H50I;

(www) a heavy chain comprising (i) the amino acid sequence of the VH of P1-068744_E59Y and (ii) the amino acid sequence of SEQ ID NO: 183, and a light chain comprising the light chain amino acid sequence of P1-068744_E59Y;

(xxx) a heavy chain comprising (i) the amino acid sequence of the VH of P1-068744_E100S and (ii) the amino acid sequence of SEQ ID NO: 183, and a light chain comprising the light chain amino acid sequence of P1-068744_E100S;

(yyy) a heavy chain comprising (i) the amino acid sequence of the VH of P1-068744_E102Y and (ii) the amino acid sequence of SEQ ID NO: 183, and a light chain comprising the light chain amino acid sequence of P1-068744_E102Y;

(zzz) a heavy chain comprising (i) the amino acid sequence of the VH of P1-068744_E31S_H50I and (ii) the amino acid sequence of SEQ ID NO: 183, and a light chain comprising the light chain amino acid sequence of P1-068744_E31S_H50I;

(aaaa) a heavy chain comprising (i) the amino acid sequence of the VH of P1-068744_H50I_E59Y and (ii) the amino acid sequence of SEQ ID NO: 183, and a light chain comprising the light chain amino acid sequence of P1-068744_H50I_E59Y;

(bbbb) a heavy chain comprising (i) the amino acid sequence of the VH of P1-068744_E59Y_E100S and (ii) the amino acid sequence of SEQ ID NO: 183, and a light chain comprising the light chain amino acid sequence of P1-068744_E5;9Y_E100S;

(cccc) a heavy chain comprising (i) the amino acid sequence of the VH of P1-068744_E100S_E102Y and (ii) the amino acid sequence of SEQ ID NO: 183, and a light chain comprising the light chain amino acid sequence of P1-068744_E100S_E102Y;

(dddd) a heavy chain comprising (i) the amino acid sequence of the VH of P1-068744_E31S_E102Y and (ii) the amino acid sequence of SEQ ID NO: 183, and a light chain comprising the light chain amino acid sequence of P1-068744_E31S_E102Y;

(eeee) a heavy chain comprising (i) the amino acid sequence of the VH of P1-068744_E31S_E59Y and (ii) the amino acid sequence of SEQ ID NO: 183, and a light chain comprising the light chain amino acid sequence of P1-068744_E31S_E59Y;

(ffff) a heavy chain comprising (i) the amino acid sequence of the VH of P1-068744_E31S_E100S and (ii) the amino acid sequence of SEQ ID NO: 183, and a light chain comprising the light chain amino acid sequence of P1-068744_E31S_E100S;

(gggg) a heavy chain comprising (i) the amino acid sequence of the VH of P1-068744_H50I_E100S and (ii) the amino acid sequence of SEQ ID NO: 183, and a light chain comprising the light chain amino acid sequence of P1-068744_H50I_E100S;

(hhhh) a heavy chain comprising (i) the amino acid sequence of the VH of P1-068744_H50I_E102Y and (ii) the amino acid sequence of SEQ ID NO: 183, and a light chain comprising the light chain amino acid sequence of P1-068744_H50I_E102Y;

(iiii) a heavy chain comprising (i) the amino acid sequence of the VH of P1-068744_E59Y_E102Y and (ii) the amino acid sequence of SEQ ID NO: 183, and a VL and a light chain comprising the light chain amino acid sequence of P1-068744_E59Y_E102Y;

(jjjj) a heavy chain comprising (i) the amino acid sequence of the VH of P1-068748_H31S and (ii) the amino acid sequence of SEQ ID NO: 183, and a light chain comprising the light chain amino acid sequence of P1-068748_H31S;

(kkkk) a heavy chain comprising (i) the amino acid sequence of the VH of P1-068748_H32Y and (ii) the amino acid sequence of SEQ ID NO: 183, and a light chain comprising the light chain amino acid sequence of P1-068748_H32Y;

(llll) a heavy chain comprising (i) the amino acid sequence of the VH of P1-068748_D57K and (ii) the amino acid sequence of SEQ ID NO: 183, and a light chain comprising the light chain amino acid sequence of P1-068748_D57K;

(mmmm) a heavy chain comprising (i) the amino acid sequence of the VH of P1-068748_D58Y and (ii) the amino acid sequence of SEQ ID NO: 183, and a light chain comprising the light chain amino acid sequence of P1-068748_D58Y;

(nnnn) a heavy chain comprising (i) the amino acid sequence of the VH of P1-068748_D100S and (ii) the amino acid sequence of SEQ ID NO: 183, and a light chain comprising the light chain amino acid sequence of P1-068748_D100S;

(oooo) a heavy chain comprising (i) the amino acid sequence of the VH of P1-068748_H31S_H32Y and (ii) the amino acid sequence of SEQ ID NO: 183, and a light chain comprising the light chain amino acid sequence of P1-068748_H31S_H32Y;

(pppp) a heavy chain comprising (i) the amino acid sequence of the VH of P1-068748_H32Y_D57K and (ii) the amino acid sequence of SEQ ID NO: 183, and a light chain comprising the light chain amino acid sequence of P1-068748_H32Y_D57K;

(qqqq) a heavy chain comprising (i) the amino acid sequence of the VH of P1-068748_D57K_D58Y and (ii) the amino acid sequence of SEQ ID NO: 183, and a light chain comprising the light chain amino acid sequence of P1-068748_D57K_D58Y;

(rrrr) a heavy chain comprising (i) the amino acid sequence of the VH of P1-068748_D58Y_D100S and (ii) the amino acid sequence of SEQ ID NO: 183, and a light chain comprising the light chain amino acid sequence of P1-068748_D58Y_D100S;

(ssss) a heavy chain comprising (i) the amino acid sequence of the VH of P1-068748_H31S_D57K and (ii) the amino acid sequence of SEQ ID NO: 183, and a light chain comprising the light chain amino acid sequence of P1-068748_H31S_D57K;

(tttt) a heavy chain comprising (i) the amino acid sequence of the VH of P1-068748_H31S_D58Y and (ii) the amino acid sequence of SEQ ID NO: 183, and a light chain comprising the light chain amino acid sequence of P1-068748_H31S_D58Y;

(uuuu) a heavy chain comprising (i) the amino acid sequence of the VH of P1-068748_H31S_D100S and (ii) the amino acid sequence of SEQ ID NO: 183, and a light chain comprising the light chain amino acid sequence of P1-068748_H31S_D100S;

(vvvv) a heavy chain comprising (i) the amino acid sequence of the VH of P1-068748_H32Y_D58Y and (ii) the amino acid sequence of SEQ ID NO: 183, and a light chain comprising the light chain amino acid sequence of P1-068748_H32Y_D58Y;

(wwww) a heavy chain comprising (i) the amino acid sequence of the VH of P1-068748_H32Y_D100S and (ii) the amino acid sequence of SEQ ID NO: 183, and a light chain comprising the light chain amino acid sequence of P1-068748_H32Y_D100S; or (xxxx) a heavy chain comprising (i) the amino acid sequence of the VH of P1-068748_D57K_D100S and (ii) the amino acid sequence of SEQ ID NO: 183, and a light chain comprising the light chain amino acid sequence of P1-068748_D57K_D100S, optionally wherein the VH in any of (a) or (c) to (ttt) comprises one or both of the K16R and T84A substitutions, and optionally wherein the VL of any of (b) or (uuu) to (xxxx) comprises a T85V substitution.

Certain embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 183, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 183, and a light chain consisting of the light chain amino acid sequence of P1-061015;

(c) a heavy chain consisting of (i) the amino acid sequence of the VH of P1-068757 and (ii) the amino acid sequence of SEQ ID NO: 183, and a light chain consisting of the light chain amino acid sequence of P1-068757;

(d) a heavy chain consisting of (i) the amino acid sequence of the VH of P1-068759 and (ii) the amino acid sequence of SEQ ID NO: 183, and a light chain consisting of the light chain amino acid sequence of P1-068759;

(e) a heavy chain consisting of (i) the amino acid sequence of the VH of P1-068761 and (ii) the amino acid sequence of SEQ ID NO: 183, and a light chain consisting of the light chain amino acid sequence of P1-068761;

(f) a heavy chain consisting of (i) the amino acid sequence of the VH of P1-068763 and (ii) the amino acid sequence of SEQ ID NO: 183, and a light chain consisting of the light chain amino acid sequence of P1-068763;

(g) a heavy chain consisting of (i) the amino acid sequence of the VH of P1-068765 and (ii) the amino acid sequence of SEQ ID NO: 183, and a light chain consisting of the light chain amino acid sequence of P1-068765;

(h) a heavy chain consisting of (i) the amino acid sequence of the VH of P1-068767 and (ii) the amino acid sequence of SEQ ID NO: 183, and a light chain consisting of the light chain amino acid sequence of P1-068767;

(i) a heavy chain consisting of (i) the amino acid sequence of the VH of P1-068769 and (ii) the amino acid sequence of SEQ ID NO: 183, and a light chain consisting of the light chain amino acid sequence of P1-068769;

(j) a heavy chain consisting of (i) the amino acid sequence of the VH of P1-068771 and (ii) the amino acid sequence of SEQ ID NO: 183, and a light chain consisting of the light chain amino acid sequence of P1-068771;

(k) a heavy chain consisting of (i) the amino acid sequence of the VH of P1-068773 and (ii) the amino acid sequence of SEQ ID NO: 183, and a light chain consisting of the light chain amino acid sequence of P1-068773;

(l) a heavy chain consisting of (i) the amino acid sequence of the VH of P1-068775 and (ii) the amino acid sequence of SEQ ID NO: 183, and a light chain consisting of the light chain amino acid sequence of P1-068775;

(m) a heavy chain consisting of (i) the amino acid sequence of the VH of P1-069059 and (ii) the amino acid sequence of SEQ ID NO: 183, and a light chain consisting of the light chain amino acid sequence of P1-069059;

(n) a heavy chain consisting of (i) the amino acid sequence of the VH of P1-069061 and (ii) the amino acid sequence of SEQ ID NO: 183, and a light chain consisting of the light chain amino acid sequence of P1-069061;

(o) a heavy chain consisting of (i) the amino acid sequence of the VH of P1-069063 and (ii) the amino acid sequence of SEQ ID NO: 183, and a light chain consisting of the light chain amino acid sequence of P1-069063;

(p) a heavy chain consisting of (i) the amino acid sequence of the VH of P1-069065 and (ii) the amino acid sequence of SEQ ID NO: 183, and a light chain consisting of the light chain amino acid sequence of P1-069065;

(q) a heavy chain consisting of (i) the amino acid sequence of the VH of P1-069067 and (ii) the amino acid sequence of SEQ ID NO: 183, and a light chain consisting of the light chain amino acid sequence of P1-069067;

(r) a heavy chain consisting of (i) the amino acid sequence of the VH of P1-069069 and (ii) the amino acid sequence of SEQ ID NO: 183, and a light chain consisting of the light chain amino acid sequence of P1-069069;

(s) a heavy chain consisting of (i) the amino acid sequence of the VH of P1-069071 and (ii) the amino acid sequence of SEQ ID NO: 183, and a light chain consisting of the light chain amino acid sequence of P1-069071;

(t) a heavy chain consisting of (i) the amino acid sequence of the VH of P1-069073 and (ii) the amino acid sequence of SEQ ID NO: 183, and a light chain consisting of the light chain amino acid sequence of P1-069073;

(u) a heavy chain consisting of (i) the amino acid sequence of the VH of P1-069075 and (ii) the amino acid sequence of SEQ ID NO: 183, and a light chain consisting of the light chain amino acid sequence of P1-069075;

(v) a heavy chain consisting of (i) the amino acid sequence of the VH of P1-069077 and (ii) the amino acid sequence of SEQ ID NO: 183, and a light chain consisting of the light chain amino acid sequence of P1-069077;

(w) a heavy chain consisting of (i) the amino acid sequence of the VH of P1-068736 and (ii) the amino acid sequence of SEQ ID NO: 183, and a light chain consisting of the light chain amino acid sequence of P1-068736;

(x) a heavy chain consisting of (i) the amino acid sequence of the VH of P1-068738 and (ii) the amino acid sequence of SEQ ID NO: 183, and a light chain consisting of the light chain amino acid sequence of P1-068738;

(y) a heavy chain consisting of (i) the amino acid sequence of the VH of P1-068740 and (ii) the amino acid sequence of SEQ ID NO: 183, and a light chain consisting of the light chain amino acid sequence of P1-068740;

(z) a heavy chain consisting of (i) the amino acid sequence of the VH of P1-068742 and (ii) the amino acid sequence of SEQ ID NO: 183, and a light chain consisting of the light chain amino acid sequence of P1-068742;

(aa) a heavy chain consisting of (i) the amino acid sequence of the VH of P1-068744 and (ii) the amino acid sequence of SEQ ID NO: 183, and a light chain consisting of the light chain amino acid sequence of P1-068744;

(bb) a heavy chain consisting of the amino acid sequence of the VH of P1-068746 and (ii) the amino acid sequence of SEQ ID NO: 183, and a light chain consisting of the light chain amino acid sequence of P1-068746;

(cc) a heavy chain consisting of (i) the amino acid sequence of the VH of P1-068748 and (ii) the amino acid sequence of SEQ ID NO: 183, and a light chain consisting of the light chain amino acid sequence of P1-068748;

(dd) a heavy chain consisting of (i) the amino acid sequence of the VH of P1-068750 and (ii) the amino acid sequence of SEQ ID NO: 183, and a light chain consisting of the light chain amino acid sequence of P1-068750;

(ee) a heavy chain consisting of (i) the amino acid sequence of the VH of P1-068752 and (ii) the amino acid sequence of SEQ ID NO: 183, and a light chain consisting of the light chain amino acid sequence of P1-068752;

(ff) a heavy chain consisting of (i) the amino acid sequence of the VH of P1-068754 and (ii) the amino acid sequence of SEQ ID NO: 183, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 183, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 183, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 183, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 183, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 183, and a light chain consisting of the light chain amino acid sequence of P1-068761_E30D;

(ll) a heavy chain consisting of (i) the amino acid sequence of the VH of P1-068761_E30D_E55A and (ii) the amino acid sequence of SEQ ID NO: 183, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 183, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 183, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 183, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 183, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 183, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 183, and a light chain consisting of the light chain amino acid sequence of P1-068761_H100G_E100fF;

(ss) a heavy chain consisting of (i) the amino acid sequence of the VH of P1-068761_E30D_E100fF and (ii) the amino acid sequence of SEQ ID NO: 183, and a light chain consisting of the light chain amino acid sequence of P1-068761_E30D_E100fF;

(tt) a heavy chain consisting of (i) the amino acid sequence of the VH of P1-068761_E56N_E100fF and (ii) the amino acid sequence of SEQ ID NO: 183, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 183, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 183, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 183, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 183, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 183, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 183, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 183, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 183, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 183, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 183, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 183, and a light chain consisting of the light chain amino acid sequence of P1-068767_D102V;

(fff) a heavy chain consisting of (i) the amino acid sequence of the VH of P1-068767_E55A and (ii) the amino acid sequence of SEQ ID NO: 183, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 183, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 183, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 183, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 183, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 183, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 183, and a light chain consisting of the light chain amino acid sequence of P1-068767_E55A_E100fF;

(mmm) a heavy chain consisting of (i) the amino acid sequence of the VH of P1-068767_D52N_E100fF and (ii) the amino acid sequence of SEQ ID NO: 183, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 183, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 183, and a light chain consisting of the light chain amino acid sequence of P1-068767_E30D_E100fF;

(ppp) a heavy chain consisting of (i) the amino acid sequence of the VH of P1-061029_F100fE_V102D and (ii) the amino acid sequence of SEQ ID NO: 183, and a light chain consisting of the light chain amino acid sequence of P1-061029_F100fE_V102D;

(qqq) a heavy chain consisting of (i) the amino acid sequence of the VH of P1-061029_F100fE and (ii) the amino acid sequence of SEQ ID NO: 183, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 183, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 183, and a light chain consisting of the light chain amino acid sequence of P1-061029_Y32E;

(ttt) a heavy chain consisting of (i) the amino acid sequence of the VH of P1-061029_Y32E_F100fE and (ii) the amino acid sequence of SEQ ID NO: 183, and a light chain consisting of the light chain amino acid sequence of P1-061029_Y32E_F100fE;

(uuu) a heavy chain consisting of (i) the amino acid sequence of the VH of P1-068744_E31S and (ii) the amino acid sequence of SEQ ID NO: 183, and a light chain consisting of the light chain amino acid sequence of P1-068744_E31S;

(vvv) a heavy chain consisting of (i) the amino acid sequence of the VH of P1-068744_H50I and (ii) the amino acid sequence of SEQ ID NO: 183, and a light chain consisting of the light chain amino acid sequence of P1-068744_H50I;

(www) a heavy chain consisting of (i) the amino acid sequence of the VH of P1-068744_E59Y and (ii) the amino acid sequence of SEQ ID NO: 183, and a light chain consisting of the light chain amino acid sequence of P1-068744_E59Y;

(xxx) a heavy chain consisting of (i) the amino acid sequence of the VH of P1-068744_E100S and (ii) the amino acid sequence of SEQ ID NO: 183, and a light chain consisting of the light chain amino acid sequence of P1-068744_E100S;

(yyy) a heavy chain consisting of (i) the amino acid sequence of the VH of P1-068744_E102Y and (ii) the amino acid sequence of SEQ ID NO: 183, and a light chain consisting of the light chain amino acid sequence of P1-068744_E102Y;

(zzz) a heavy chain consisting of (i) the amino acid sequence of the VH of P1-068744_E31S_H50I and (ii) the amino acid sequence of SEQ ID NO: 183, and a light chain consisting of the light chain amino acid sequence of P1-068744_E31S_H50I;

(aaaa) a heavy chain consisting of (i) the amino acid sequence of the VH of P1-068744_H50I_E59Y and (ii) the amino acid sequence of SEQ ID NO: 183, and a light chain consisting of the light chain amino acid sequence of P1-068744_H50I_E59Y;

(bbbb) a heavy chain consisting of (i) the amino acid sequence of the VH of P1-068744_E59Y_E100S and (ii) the amino acid sequence of SEQ ID NO: 183, and a light chain consisting of the light chain amino acid sequence of P1-068744_E5;9Y_E100S;

(cccc) a heavy chain consisting of (i) the amino acid sequence of the VH of P1-068744_E100S_E102Y and (ii) the amino acid sequence of SEQ ID NO: 183, and a light chain consisting of the light chain amino acid sequence of P1-068744_E100S_E102Y;

(dddd) a heavy chain consisting of (i) the amino acid sequence of the VH of P1-068744_E31S_E102Y and (ii) the amino acid sequence of SEQ ID NO: 183, and a light chain consisting of the light chain amino acid sequence of P1-068744_E31S_E102Y;

(eeee) a heavy chain consisting of (i) the amino acid sequence of the VH of P1-068744_E31S_E59Y and (ii) the amino acid sequence of SEQ ID NO: 183, and a light chain consisting of the light chain amino acid sequence of P1-068744_E31S_E59Y;

(ffff) a heavy chain consisting of (i) the amino acid sequence of the VH of P1-068744_E31S_E100S and (ii) the amino acid sequence of SEQ ID NO: 183, and a light chain consisting of the light chain amino acid sequence of P1-068744_E31S_E100S;

(gggg) a heavy chain consisting of (i) the amino acid sequence of the VH of P1-068744_H50I_E100S and (ii) the amino acid sequence of SEQ ID NO: 183, and a light chain consisting of the light chain amino acid sequence of P1-068744_H50I_E100S;

(hhhh) a heavy chain consisting of (i) the amino acid sequence of the VH of P1-068744_H50I_E102Y and (ii) the amino acid sequence of SEQ ID NO: 183, and a light chain consisting of the light chain amino acid sequence of P1-068744_H50I_E102Y;

(iiii) a heavy chain consisting of (i) the amino acid sequence of the VH of P1-068744_E59Y_E102Y and (ii) the amino acid sequence of SEQ ID NO: 183, and a VL and a light chain consisting of the light chain amino acid sequence of P1-068744_E59Y_E102Y;

(jjjj) a heavy chain consisting of (i) the amino acid sequence of the VH of P1-068748_H31S and (ii) the amino acid sequence of SEQ ID NO: 183, and a light chain consisting of the light chain amino acid sequence of P1-068748_H31S;

(kkkk) a heavy chain consisting of (i) the amino acid sequence of the VH of P1-068748_H32Y and (ii) the amino acid sequence of SEQ ID NO: 183, and a light chain consisting of the light chain amino acid sequence of P1-068748_H32Y;

(llll) a heavy chain consisting of (i) the amino acid sequence of the VH of P1-068748_D57K and (ii) the amino acid sequence of SEQ ID NO: 183, and a light chain consisting of the light chain amino acid sequence of P1-068748_D57K;

(mmmm) a heavy chain consisting of (i) the amino acid sequence of the VH of P1-068748_D58Y and (ii) the amino acid sequence of SEQ ID NO: 183, and a light chain consisting of the light chain amino acid sequence of P1-068748_D58Y;

(nnnn) a heavy chain consisting of (i) the amino acid sequence of the VH of P1-068748_D100S and (ii) the amino acid sequence of SEQ ID NO: 183, and a light chain consisting of the light chain amino acid sequence of P1-068748_D100S;

(oooo) a heavy chain consisting of (i) the amino acid sequence of the VH of P1-068748_H31S_H32Y and (ii) the amino acid sequence of SEQ ID NO: 183, and a light chain consisting of the light chain amino acid sequence of P1-068748_H31S_H32Y;

(pppp) a heavy chain consisting of (i) the amino acid sequence of the VH of P1-068748_H32Y_D57K and (ii) the amino acid sequence of SEQ ID NO: 183, and a light chain consisting of the light chain amino acid sequence of P1-068748_H32Y_D57K;

(qqqq) a heavy chain consisting of (i) the amino acid sequence of the VH of P1-068748_D57K_D58Y and (ii) the amino acid sequence of SEQ ID NO: 183, and a light chain consisting of the light chain amino acid sequence of P1-068748_D57K_D58Y;

(rrrr) a heavy chain consisting of (i) the amino acid sequence of the VH of P1-068748_D58Y_D100S and (ii) the amino acid sequence of SEQ ID NO: 183, and a light chain consisting of the light chain amino acid sequence of P1-068748_D58Y_D100S;

(ssss) a heavy chain consisting of (i) the amino acid sequence of the VH of P1-068748_H31S_D57K and (ii) the amino acid sequence of SEQ ID NO: 183, and a light chain consisting of the light chain amino acid sequence of P1-068748_H31S_D57K;

(tttt) a heavy chain consisting of (i) the amino acid sequence of the VH of P1-068748_H31S_D58Y and (ii) the amino acid sequence of SEQ ID NO: 183, and a light chain consisting of the light chain amino acid sequence of P1-068748_H31S_D58Y;

(uuuu) a heavy chain consisting of (i) the amino acid sequence of the VH of P1-068748_H31S_D100S and (ii) the amino acid sequence of SEQ ID NO: 183, and a light chain consisting of the light chain amino acid sequence of P1-068748_H31S_D100S;

(vvvv) a heavy chain consisting of (i) the amino acid sequence of the VH of P1-068748_H32Y_D58Y and (ii) the amino acid sequence of SEQ ID NO: 183, and a light chain consisting of the light chain amino acid sequence of P1-068748_H32Y_D58Y;

(wwww) a heavy chain consisting of (i) the amino acid sequence of the VH of P1-068748_H32Y_D100S and (ii) the amino acid sequence of SEQ ID NO: 183, and a light chain consisting of the light chain amino acid sequence of P1-068748_H32Y_D100S; or (xxxx) a heavy chain consisting of (i) the amino acid sequence of the VH of P1-068748_D57K_D100S and (ii) the amino acid sequence of SEQ ID NO: 183, and a light chain consisting of the light chain amino acid sequence of P1-068748_D57K_D100S, wherein the C-terminal amino acid of VH and the N-terminal amino acid of SEQ ID NO: 183 form a peptidic bond; and optionally wherein the VH in any of (a) or (c) to (ttt) comprises one or both of the K16R and T84A substitutions, and optionally wherein the VL of any of (b) or (uuu) to (xxxx) comprises a T85V substitution.

In some embodiments, the disclosure contemplates anti-VISTA mAbs comprising:

a heavy chain consisting of the amino acid sequences of (i) a VH of (a) to (xxxx) listed above, (ii) SEQ ID NO: 183, and (iii) a Lys residue, wherein the C-terminal amino acid of VH and the N-terminal amino acid of SEQ ID NO: 183 form a peptidic bond and wherein the C-terminal amino acid of SEQ ID NO: 183 is joined to the N-terminal of the Lys; and a light chain consisting of the light chain amino acid sequence of (a) to (xxxx) listed above;

wherein the VH and light chain amino acid sequences are chosen from the same antibody species from among (a) to (xxxx) listed above.

Further embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 184, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 184, and a light chain comprising the light chain amino acid sequence of P1-061015;

(c) a heavy chain comprising (i) the amino acid sequence of the VH of P1-068757 and (ii) the amino acid sequence of SEQ ID NO: 184, and a light chain comprising the light chain amino acid sequence of P1-068757;

(d) a heavy chain comprising (i) the amino acid sequence of the VH of P1-068759 and (ii) the amino acid sequence of SEQ ID NO: 184, and a light chain comprising the light chain amino acid sequence of P1-068759;

(e) a heavy chain comprising (i) the amino acid sequence of the VH of P1-068761 and (ii) the amino acid sequence of SEQ ID NO: 184, and a light chain comprising the light chain amino acid sequence of P1-068761;

(f) a heavy chain comprising (i) the amino acid sequence of the VH of P1-068763 and (ii) the amino acid sequence of SEQ ID NO: 184, and a light chain comprising the light chain amino acid sequence of P1-068763;

(g) a heavy chain comprising (i) the amino acid sequence of the VH of P1-068765 and (ii) the amino acid sequence of SEQ ID NO: 184, and a light chain comprising the light chain amino acid sequence of P1-068765;

(h) a heavy chain comprising (i) the amino acid sequence of the VH of P1-068767 and (ii) the amino acid sequence of SEQ ID NO: 184, and a light chain comprising the light chain amino acid sequence of P1-068767;

(i) a heavy chain comprising (i) the amino acid sequence of the VH of P1-068769 and (ii) the amino acid sequence of SEQ ID NO: 184, and a light chain comprising the light chain amino acid sequence of P1-068769;

(j) a heavy chain comprising (i) the amino acid sequence of the VH of P1-068771 and (ii) the amino acid sequence of SEQ ID NO: 184, and a light chain comprising the light chain amino acid sequence of P1-068771;

(k) a heavy chain comprising (i) the amino acid sequence of the VH of P1-068773 and (ii) the amino acid sequence of SEQ ID NO: 184, and a light chain comprising the light chain amino acid sequence of P1-068773;

(l) a heavy chain comprising (i) the amino acid sequence of the VH of P1-068775 and (ii) the amino acid sequence of SEQ ID NO: 184, and a light chain comprising the light chain amino acid sequence of P1-068775;

(m) a heavy chain comprising (i) the amino acid sequence of the VH of P1-069059 and (ii) the amino acid sequence of SEQ ID NO: 184, and a light chain comprising the light chain amino acid sequence of P1-069059;

(n) a heavy chain comprising (i) the amino acid sequence of the VH of P1-069061 and (ii) the amino acid sequence of SEQ ID NO: 184, and a light chain comprising the light chain amino acid sequence of P1-069061;

(o) a heavy chain comprising (i) the amino acid sequence of the VH of P1-069063 and (ii) the amino acid sequence of SEQ ID NO: 184, and a light chain comprising the light chain amino acid sequence of P1-069063;

(p) a heavy chain comprising (i) the amino acid sequence of the VH of P1-069065 and (ii) the amino acid sequence of SEQ ID NO: 184, and a light chain comprising the light chain amino acid sequence of P1-069065;

(q) a heavy chain comprising (i) the amino acid sequence of the VH of P1-069067 and (ii) the amino acid sequence of SEQ ID NO: 184, and a light chain comprising the light chain amino acid sequence of P1-069067;

(r) a heavy chain comprising (i) the amino acid sequence of the VH of P1-069069 and (ii) the amino acid sequence of SEQ ID NO: 184, and a light chain comprising the light chain amino acid sequence of P1-069069;

(s) a heavy chain comprising (i) the amino acid sequence of the VH of P1-069071 and (ii) the amino acid sequence of SEQ ID NO: 184, and a light chain comprising the light chain amino acid sequence of P1-069071;

(t) a heavy chain comprising (i) the amino acid sequence of the VH of P1-069073 and (ii) the amino acid sequence of SEQ ID NO: 184, and a light chain comprising the light chain amino acid sequence of P1-069073;

(u) a heavy chain comprising (i) the amino acid sequence of the VH of P1-069075 and (ii) the amino acid sequence of SEQ ID NO: 184, and a light chain comprising the light chain amino acid sequence of P1-069075;

(v) a heavy chain comprising (i) the amino acid sequence of the VH of P1-069077 and (ii) the amino acid sequence of SEQ ID NO: 184, and a light chain comprising the light chain amino acid sequence of P1-069077;

(w) a heavy chain comprising (i) the amino acid sequence of the VH of P1-068736 and (ii) the amino acid sequence of SEQ ID NO: 184, and a light chain comprising the light chain amino acid sequence of P1-068736;

(x) a heavy chain comprising (i) the amino acid sequence of the VH of P1-068738 and (ii) the amino acid sequence of SEQ ID NO: 184, and a light chain comprising the light chain amino acid sequence of P1-068738;

(y) a heavy chain comprising (i) the amino acid sequence of the VH of P1-068740 and (ii) the amino acid sequence of SEQ ID NO: 184, and a light chain comprising the light chain amino acid sequence of P1-068740;

(z) a heavy chain comprising (i) the amino acid sequence of the VH of P1-068742 and (ii) the amino acid sequence of SEQ ID NO: 184, and a light chain comprising the light chain amino acid sequence of P1-068742;

(aa) a heavy chain comprising (i) the amino acid sequence of the VH of P1-068744 and (ii) the amino acid sequence of SEQ ID NO: 184, and a light chain comprising the light chain amino acid sequence of P1-068744;

(bb) a heavy chain comprising the amino acid sequence of the VH of P1-068746 and (ii) the amino acid sequence of SEQ ID NO: 184, and a light chain comprising the light chain amino acid sequence of P1-068746;

(cc) a heavy chain comprising (i) the amino acid sequence of the VH of P1-068748 and (ii) the amino acid sequence of SEQ ID NO: 184, and a light chain comprising the light chain amino acid sequence of P1-068748;

(dd) a heavy chain comprising (i) the amino acid sequence of the VH of P1-068750 and (ii) the amino acid sequence of SEQ ID NO: 184, and a light chain comprising the light chain amino acid sequence of P1-068750;

(ee) a heavy chain comprising (i) the amino acid sequence of the VH of P1-068752 and (ii) the amino acid sequence of SEQ ID NO: 184, and a light chain comprising the light chain amino acid sequence of P1-068752;

(ff) a heavy chain comprising (i) the amino acid sequence of the VH of P1-068754 and (ii) the amino acid sequence of SEQ ID NO: 184, and a light chain comprising the light chain amino acid sequence of P1-068754;

(gg) a heavy chain comprising (i) the amino acid sequence of the VH of P1-068761_E55A and (ii) the amino acid sequence of SEQ ID NO: 184, and a light chain comprising the light chain amino acid sequence of P1-068761_E55A;

(hh) a heavy chain comprising (i) the amino acid sequence of the VH of P1-068761_H100G and (ii) the amino acid sequence of SEQ ID NO: 184, and a light chain comprising the light chain amino acid sequence of P1-068761_H100G;

(ii) a heavy chain comprising (i) the amino acid sequence of the VH of P1-068761_E56N and (ii) the amino acid sequence of SEQ ID NO: 184, and a light chain comprising the light chain amino acid sequence of P1-068761_E56N;

(jj) a heavy chain comprising (i) the amino acid sequence of the VH of P1-068761_E55A_E56N and (ii) the amino acid sequence of SEQ ID NO: 184, and a light chain comprising the light chain amino acid sequence of P1-068761_E55A_E56N;

(kk) a heavy chain comprising (i) the amino acid sequence of the VH of P1-068761_E30D and (ii) the amino acid sequence of SEQ ID NO: 184, and a light chain comprising the light chain amino acid sequence of P1-068761_E30D;

(ll) a heavy chain comprising (i) the amino acid sequence of the VH of P1-068761_E30D_E55A and (ii) the amino acid sequence of SEQ ID NO: 184, and a light chain comprising the light chain amino acid sequence of P1-068761_E30D_E55A;

(mm) a heavy chain comprising (i) the amino acid sequence of the VH of P1-068761_E56N_H100G and (ii) the amino acid sequence of SEQ ID NO: 184, and a light chain comprising the light chain amino acid sequence of P1-068761_E56N_H100G;

(nn) a heavy chain comprising (i) the amino acid sequence of the VH of P1-068761_E30D_H100G and (ii) the amino acid sequence of SEQ ID NO: 184, and a light chain comprising the light chain amino acid sequence of P1-068761_E30D_H100G;

(oo) a heavy chain comprising (i) the amino acid sequence of the VH of P1-068761_E30D_E56N and (ii) the amino acid sequence of SEQ ID NO: 184, and a light chain comprising the light chain amino acid sequence of P1-068761_E30D_E56N;

(pp) a heavy chain comprising (i) the amino acid sequence of the VH of P1-068761_E100fF and (ii) the amino acid sequence of SEQ ID NO: 184, and a light chain comprising the light chain amino acid sequence of P1-068761_E100fF;

(qq) a heavy chain comprising (i) the amino acid sequence of the VH of P1-068761_E55A_E100fF and (ii) the amino acid sequence of SEQ ID NO: 184, and a light chain comprising the light chain amino acid sequence of P1-068761_E55A_E100fF;

(rr) a heavy chain comprising (i) the amino acid sequence of the VH of P1-068761_H100G_E100fF and (ii) the amino acid sequence of SEQ ID NO: 184, and a light chain comprising the light chain amino acid sequence of P1-068761_H100G_E100fF;

(ss) a heavy chain comprising (i) the amino acid sequence of the VH of P1-068761_E30D_E100fF and (ii) the amino acid sequence of SEQ ID NO: 184, and a light chain comprising the light chain amino acid sequence of P1-068761_E30D_E100fF;

(tt) a heavy chain comprising (i) the amino acid sequence of the VH of P1-068761_E56N_E100fF and (ii) the amino acid sequence of SEQ ID NO: 184, and a light chain comprising the light chain amino acid sequence of P1-068761_E56N_E100fF;

(uu) a heavy chain comprising (i) the amino acid sequence of the VH of P1-068761_E32Y and (ii) the amino acid sequence of SEQ ID NO: 184, and a light chain comprising the light chain amino acid sequence of P1-068761_E32Y;

(vv) a heavy chain comprising (i) the amino acid sequence of the VH of P1-068761_E32Y_E55A and (ii) the amino acid sequence of SEQ ID NO: 184, and a light chain comprising the light chain amino acid sequence of P1-068761_E32Y_E55A;

(ww) a heavy chain comprising (i) the amino acid sequence of the VH of P1-068761_E32Y_E56N and (ii) the amino acid sequence of SEQ ID NO: 184, and a light chain comprising the light chain amino acid sequence of P1-068761_E32Y_E56N;

(xx) a heavy chain comprising (i) the amino acid sequence of the VH of P1-068761_E30D_E32Y and (ii) the amino acid sequence of SEQ ID NO: 184, and a light chain comprising the light chain amino acid sequence of P1-068761_E30D_E32Y;

(yy) a heavy chain comprising (i) the amino acid sequence of the VH of P1-068761_E32Y_H100G and (ii) the amino acid sequence of SEQ ID NO: 184, and a light chain comprising the light chain amino acid sequence of P1-068761_E32Y_H100G;

(zz) a heavy chain comprising (i) the amino acid sequence of the VH of P1-068761_E32Y_E100fF and (ii) the amino acid sequence of SEQ ID NO: 184, and a light chain comprising the light chain amino acid sequence of P1-068761_E32Y_E100fF;

(aaa) a heavy chain comprising (i) the amino acid sequence of the VH of P1-068767_D52N_D102V and (ii) the amino acid sequence of SEQ ID NO: 184, and a light chain comprising the light chain amino acid sequence of P1-068767_D52N_D102V;

(bbb) a heavy chain comprising (i) the amino acid sequence of the VH of P1-068767_D52N and (ii) the amino acid sequence of SEQ ID NO: 184, and a light chain comprising the light chain amino acid sequence of P1-068767_D52N;

(ccc) a heavy chain comprising (i) the amino acid sequence of the VH of P1-068767_D52N_E55A and (ii) the amino acid sequence of SEQ ID NO: 184, and a light chain comprising the light chain amino acid sequence of P1-068767_D52N_E55A;

(ddd) a heavy chain comprising (i) the amino acid sequence of the VH of P1-068767_E55A_D102V and (ii) the amino acid sequence of SEQ ID NO: 184, and a light chain comprising the light chain amino acid sequence of P1-068767_E55A_D102V;

(eee) a heavy chain comprising (i) the amino acid sequence of the VH of P1-068767_D102V and (ii) the amino acid sequence of SEQ ID NO: 184, and a light chain comprising the light chain amino acid sequence of P1-068767_D102V;

(fff) a heavy chain comprising (i) the amino acid sequence of the VH of P1-068767_E55A and (ii) the amino acid sequence of SEQ ID NO: 184, and a light chain comprising the light chain amino acid sequence of P1-068767_E55A;

(ggg) a heavy chain comprising (i) the amino acid sequence of the VH of P1-068767_E30D_D52N and (ii) the amino acid sequence of SEQ ID NO: 184, and a light chain comprising the light chain amino acid sequence of P1-068767_E30D_D52N;

(hhh) a heavy chain comprising (i) the amino acid sequence of the VH of P1-068767_E30D_D102V and (ii) the amino acid sequence of SEQ ID NO: 184, and a light chain comprising the light chain amino acid sequence of P1-068767_E30D_D102V;

(iii) a heavy chain comprising (i) the amino acid sequence of the VH of P1-068767_E30D and (ii) the amino acid sequence of SEQ ID NO: 184, and a light chain comprising the light chain amino acid sequence of P1-068767_E30D;

(jjj) a heavy chain comprising (i) the amino acid sequence of the VH of P1-068767_E30D_E55A and (ii) the amino acid sequence of SEQ ID NO: 184, and a light chain comprising the light chain amino acid sequence of P1-068767_E30D_E55A;

(kkk) a heavy chain comprising (i) the amino acid sequence of the VH of P1-068767_E100fF_D102V and (ii) the amino acid sequence of SEQ ID NO: 184, and a light chain comprising the light chain amino acid sequence of P1-068767_E100fF_D102V;

(lll) a heavy chain comprising (i) the amino acid sequence of the VH of P1-068767_E55A_E100fF and (ii) the amino acid sequence of SEQ ID NO: 184, and a light chain comprising the light chain amino acid sequence of P1-068767_E55A_E100fF;

(mmm) a heavy chain comprising (i) the amino acid sequence of the VH of P1-068767_D52N_E100fF and (ii) the amino acid sequence of SEQ ID NO: 184, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 184, and a light chain comprising the light chain amino acid sequence of P1-068767_E100fF;

(ooo) a heavy chain comprising (i) the amino acid sequence of the VH of P1-068767_E30D_E100fF and (ii) the amino acid sequence of SEQ ID NO: 184, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 184, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 184, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 184, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 184, and a light chain comprising the light chain amino acid sequence of P1-061029_Y32E;

(ttt) a heavy chain comprising (i) the amino acid sequence of the VH of P1-061029_Y32E_F100fE and (ii) the amino acid sequence of SEQ ID NO: 184, and a light chain comprising the light chain amino acid sequence of P1-061029_Y32E_F100fE;

(uuu) a heavy chain comprising (i) the amino acid sequence of the VH of P1-068744_E31S and (ii) the amino acid sequence of SEQ ID NO: 184, and a light chain comprising the light chain amino acid sequence of P1-068744_E31S;

(vvv) a heavy chain comprising (i) the amino acid sequence of the VH of P1-068744_H50I and (ii) the amino acid sequence of SEQ ID NO: 184, and a light chain comprising the light chain amino acid sequence of P1-068744_H50I;

(www) a heavy chain comprising (i) the amino acid sequence of the VH of P1-068744_E59Y and (ii) the amino acid sequence of SEQ ID NO: 184, and a light chain comprising the light chain amino acid sequence of P1-068744_E59Y;

(xxx) a heavy chain comprising (i) the amino acid sequence of the VH of P1-068744_E100S and (ii) the amino acid sequence of SEQ ID NO: 184, and a light chain comprising the light chain amino acid sequence of P1-068744_E100S;

(yyy) a heavy chain comprising (i) the amino acid sequence of the VH of P1-068744_E102Y and (ii) the amino acid sequence of SEQ ID NO: 184, and a light chain comprising the light chain amino acid sequence of P1-068744_E102Y;

(zzz) a heavy chain comprising (i) the amino acid sequence of the VH of P1-068744_E31S_H50I and (ii) the amino acid sequence of SEQ ID NO: 184, and a light chain comprising the light chain amino acid sequence of P1-068744_E31S_H50I;

(aaaa) a heavy chain comprising (i) the amino acid sequence of the VH of P1-068744_H50I_E59Y and (ii) the amino acid sequence of SEQ ID NO: 184, and a light chain comprising the light chain amino acid sequence of P1-068744_H50I_E59Y;

(bbbb) a heavy chain comprising (i) the amino acid sequence of the VH of P1-068744_E59Y_E100S and (ii) the amino acid sequence of SEQ ID NO: 184, and a light chain comprising the light chain amino acid sequence of P1-068744_E5;9Y_E100S;

(cccc) a heavy chain comprising (i) the amino acid sequence of the VH of P1-068744_E100S_E102Y and (ii) the amino acid sequence of SEQ ID NO: 184, and a light chain comprising the light chain amino acid sequence of P1-068744_E100S_E102Y;

(dddd) a heavy chain comprising (i) the amino acid sequence of the VH of P1-068744_E31S_E102Y and (ii) the amino acid sequence of SEQ ID NO: 184, and a light chain comprising the light chain amino acid sequence of P1-068744_E31S_E102Y;

(eeee) a heavy chain comprising (i) the amino acid sequence of the VH of P1-068744_E31S_E59Y and (ii) the amino acid sequence of SEQ ID NO: 184, and a light chain comprising the light chain amino acid sequence of P1-068744_E31S_E59Y;

(ffff) a heavy chain comprising (i) the amino acid sequence of the VH of P1-068744_E31S_E100S and (ii) the amino acid sequence of SEQ ID NO: 184, and a light chain comprising the light chain amino acid sequence of P1-068744_E31S_E100S;

(gggg) a heavy chain comprising (i) the amino acid sequence of the VH of P1-068744_H50I_E100S and (ii) the amino acid sequence of SEQ ID NO: 184, and a light chain comprising the light chain amino acid sequence of P1-068744_H50I_E100S;

(hhhh) a heavy chain comprising (i) the amino acid sequence of the VH of P1-068744_H50I_E102Y and (ii) the amino acid sequence of SEQ ID NO: 184, and a light chain comprising the light chain amino acid sequence of P1-068744_H50I_E102Y;

(iiii) a heavy chain comprising (i) the amino acid sequence of the VH of P1-068744_E59Y_E102Y and (ii) the amino acid sequence of SEQ ID NO: 184, and a VL and a light chain comprising the light chain amino acid sequence of P1-068744_E59Y_E102Y;

(jjjj) a heavy chain comprising (i) the amino acid sequence of the VH of P1-068748_H31S and (ii) the amino acid sequence of SEQ ID NO: 184, and a light chain comprising the light chain amino acid sequence of P1-068748_H31S;

(kkkk) a heavy chain comprising (i) the amino acid sequence of the VH of P1-068748_H32Y and (ii) the amino acid sequence of SEQ ID NO: 184, and a light chain comprising the light chain amino acid sequence of P1-068748_H32Y;

(llll) a heavy chain comprising (i) the amino acid sequence of the VH of P1-068748_D57K and (ii) the amino acid sequence of SEQ ID NO: 184, and a light chain comprising the light chain amino acid sequence of P1-068748_D57K;

(mmmm) a heavy chain comprising (i) the amino acid sequence of the VH of P1-068748_D58Y and (ii) the amino acid sequence of SEQ ID NO: 184, and a light chain comprising the light chain amino acid sequence of P1-068748_D58Y;

(nnnn) a heavy chain comprising (i) the amino acid sequence of the VH of P1-068748_D100S and (ii) the amino acid sequence of SEQ ID NO: 184, and a light chain comprising the light chain amino acid sequence of P1-068748_D100S;

(oooo) a heavy chain comprising (i) the amino acid sequence of the VH of P1-068748_H31S_H32Y and (ii) the amino acid sequence of SEQ ID NO: 184, and a light chain comprising the light chain amino acid sequence of P1-068748_H31S_H32Y;

(pppp) a heavy chain comprising (i) the amino acid sequence of the VH of P1-068748_H32Y_D57K and (ii) the amino acid sequence of SEQ ID NO: 184, and a light chain comprising the light chain amino acid sequence of P1-068748_H32Y_D57K;

(qqqq) a heavy chain comprising (i) the amino acid sequence of the VH of P1-068748_D57K_D58Y and (ii) the amino acid sequence of SEQ ID NO: 184, and a light chain comprising the light chain amino acid sequence of P1-068748_D57K_D58Y;

(rrrr) a heavy chain comprising (i) the amino acid sequence of the VH of P1-068748_D58Y_D100S and (ii) the amino acid sequence of SEQ ID NO: 184, and a light chain comprising the light chain amino acid sequence of P1-068748_D58Y_D100S;

(ssss) a heavy chain comprising (i) the amino acid sequence of the VH of P1-068748_H31S_D57K and (ii) the amino acid sequence of SEQ ID NO: 184, and a light chain comprising the light chain amino acid sequence of P1-068748_H31S_D57K;

(tttt) a heavy chain comprising (i) the amino acid sequence of the VH of P1-068748_H31S_D58Y and (ii) the amino acid sequence of SEQ ID NO: 184, and a light chain comprising the light chain amino acid sequence of P1-068748_H31S_D58Y;

(uuuu) a heavy chain comprising (i) the amino acid sequence of the VH of P1-068748_H31S_D100S and (ii) the amino acid sequence of SEQ ID NO: 184, and a light chain comprising the light chain amino acid sequence of P1-068748_H31S_D100S;

(vvvv) a heavy chain comprising (i) the amino acid sequence of the VH of P1-068748_H32Y_D58Y and (ii) the amino acid sequence of SEQ ID NO: 184, and a light chain comprising the light chain amino acid sequence of P1-068748_H32Y_D58Y;

(wwww) a heavy chain comprising (i) the amino acid sequence of the VH of P1-068748_H32Y_D100S and (ii) the amino acid sequence of SEQ ID NO: 184, and a light chain comprising the light chain amino acid sequence of P1-068748_H32Y_D100S; or (xxxx) a heavy chain comprising (i) the amino acid sequence of the VH of P1-068748_D57K_D100S and (ii) the amino acid sequence of SEQ ID NO: 184, and a light chain comprising the light chain amino acid sequence of P1-068748_D57K_D100S, and optionally wherein the VH in any of (a) or (c) to (ttt) comprises one or both of the K16R and T84A substitutions, and optionally wherein the VL any of (b) or (uuu) to (xxxx) comprises a T85V substitution.

Yet further embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 184, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 184, and a light chain consisting of the light chain amino acid sequence of P1-061015;

(c) a heavy chain consisting of (i) the amino acid sequence of the VH of P1-068757 and (ii) the amino acid sequence of SEQ ID NO: 184, and a light chain consisting of the light chain amino acid sequence of P1-068757;

(d) a heavy chain consisting of (i) the amino acid sequence of the VH of P1-068759 and (ii) the amino acid sequence of SEQ ID NO: 184, and a light chain consisting of the light chain amino acid sequence of P1-068759;

(e) a heavy chain consisting of (i) the amino acid sequence of the VH of P1-068761 and (ii) the amino acid sequence of SEQ ID NO: 184, and a light chain consisting of the light chain amino acid sequence of P1-068761;

(f) a heavy chain consisting of (i) the amino acid sequence of the VH of P1-068763 and (ii) the amino acid sequence of SEQ ID NO: 184, and a light chain consisting of the light chain amino acid sequence of P1-068763;

(g) a heavy chain consisting of (i) the amino acid sequence of the VH of P1-068765 and (ii) the amino acid sequence of SEQ ID NO: 184, and a light chain consisting of the light chain amino acid sequence of P1-068765;

(h) a heavy chain consisting of (i) the amino acid sequence of the VH of P1-068767 and (ii) the amino acid sequence of SEQ ID NO: 184, and a light chain consisting of the light chain amino acid sequence of P1-068767;

(i) a heavy chain consisting of (i) the amino acid sequence of the VH of P1-068769 and (ii) the amino acid sequence of SEQ ID NO: 184, and a light chain consisting of the light chain amino acid sequence of P1-068769;

(j) a heavy chain consisting of (i) the amino acid sequence of the VH of P1-068771 and (ii) the amino acid sequence of SEQ ID NO: 184, and a light chain consisting of the light chain amino acid sequence of P1-068771;

(k) a heavy chain consisting of (i) the amino acid sequence of the VH of P1-068773 and (ii) the amino acid sequence of SEQ ID NO: 184, and a light chain consisting of the light chain amino acid sequence of P1-068773;

(l) a heavy chain consisting of (i) the amino acid sequence of the VH of P1-068775 and (ii) the amino acid sequence of SEQ ID NO: 184, and a light chain consisting of the light chain amino acid sequence of P1-068775;

(m) a heavy chain consisting of (i) the amino acid sequence of the VH of P1-069059 and (ii) the amino acid sequence of SEQ ID NO: 184, and a light chain consisting of the light chain amino acid sequence of P1-069059;

(n) a heavy chain consisting of (i) the amino acid sequence of the VH of P1-069061 and (ii) the amino acid sequence of SEQ ID NO: 184, and a light chain consisting of the light chain amino acid sequence of P1-069061;

(o) a heavy chain consisting of (i) the amino acid sequence of the VH of P1-069063 and (ii) the amino acid sequence of SEQ ID NO: 184, and a light chain consisting of the light chain amino acid sequence of P1-069063;

(p) a heavy chain consisting of (i) the amino acid sequence of the VH of P1-069065 and (ii) the amino acid sequence of SEQ ID NO: 184, and a light chain consisting of the light chain amino acid sequence of P1-069065;

(q) a heavy chain consisting of (i) the amino acid sequence of the VH of P1-069067 and (ii) the amino acid sequence of SEQ ID NO: 184, and a light chain consisting of the light chain amino acid sequence of P1-069067;

(r) a heavy chain consisting of (i) the amino acid sequence of the VH of P1-069069 and (ii) the amino acid sequence of SEQ ID NO: 184, and a light chain consisting of the light chain amino acid sequence of P1-069069;

(s) a heavy chain consisting of (i) the amino acid sequence of the VH of P1-069071 and (ii) the amino acid sequence of SEQ ID NO: 184, and a light chain consisting of the light chain amino acid sequence of P1-069071;

(t) a heavy chain consisting of (i) the amino acid sequence of the VH of P1-069073 and (ii) the amino acid sequence of SEQ ID NO: 184, and a light chain consisting of the light chain amino acid sequence of P1-069073;

(u) a heavy chain consisting of (i) the amino acid sequence of the VH of P1-069075 and (ii) the amino acid sequence of SEQ ID NO: 184, and a light chain consisting of the light chain amino acid sequence of P1-069075;

(v) a heavy chain consisting of (i) the amino acid sequence of the VH of P1-069077 and (ii) the amino acid sequence of SEQ ID NO: 184, and a light chain consisting of the light chain amino acid sequence of P1-069077;

(w) a heavy chain consisting of (i) the amino acid sequence of the VH of P1-068736 and (ii) the amino acid sequence of SEQ ID NO: 184, and a light chain consisting of the light chain amino acid sequence of P1-068736;

(x) a heavy chain consisting of (i) the amino acid sequence of the VH of P1-068738 and (ii) the amino acid sequence of SEQ ID NO: 184, and a light chain consisting of the light chain amino acid sequence of P1-068738;

(y) a heavy chain consisting of (i) the amino acid sequence of the VH of P1-068740 and (ii) the amino acid sequence of SEQ ID NO: 184, and a light chain consisting of the light chain amino acid sequence of P1-068740;

(z) a heavy chain consisting of (i) the amino acid sequence of the VH of P1-068742 and (ii) the amino acid sequence of SEQ ID NO: 184, and a light chain consisting of the light chain amino acid sequence of P1-068742;

(aa) a heavy chain consisting of (i) the amino acid sequence of the VH of P1-068744 and (ii) the amino acid sequence of SEQ ID NO: 184, and a light chain consisting of the light chain amino acid sequence of P1-068744;

(bb) a heavy chain consisting of the amino acid sequence of the VH of P1-068746 and (ii) the amino acid sequence of SEQ ID NO: 184, and a light chain consisting of the light chain amino acid sequence of P1-068746;

(cc) a heavy chain consisting of (i) the amino acid sequence of the VH of P1-068748 and (ii) the amino acid sequence of SEQ ID NO: 184, and a light chain consisting of the light chain amino acid sequence of P1-068748;

(dd) a heavy chain consisting of (i) the amino acid sequence of the VH of P1-068750 and (ii) the amino acid sequence of SEQ ID NO: 184, and a light chain consisting of the light chain amino acid sequence of P1-068750;

(ee) a heavy chain consisting of (i) the amino acid sequence of the VH of P1-068752 and (ii) the amino acid sequence of SEQ ID NO: 184, and a light chain consisting of the light chain amino acid sequence of P1-068752;

(ff) a heavy chain consisting of (i) the amino acid sequence of the VH of P1-068754 and (ii) the amino acid sequence of SEQ ID NO: 184, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 184, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 184, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 184, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 184, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 184, and a light chain consisting of the light chain amino acid sequence of P1-068761_E30D;

(ll) a heavy chain consisting of (i) the amino acid sequence of the VH of P1-068761_E30D_E55A and (ii) the amino acid sequence of SEQ ID NO: 184, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 184, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 184, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 184, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 184, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 184, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 184, and a light chain consisting of the light chain amino acid sequence of P1-068761_H100G_E100fF;

(ss) a heavy chain consisting of (i) the amino acid sequence of the VH of P1-068761_E30D_E100fF and (ii) the amino acid sequence of SEQ ID NO: 184, and a light chain consisting of the light chain amino acid sequence of P1-068761_E30D_E100fF;

(tt) a heavy chain consisting of (i) the amino acid sequence of the VH of P1-068761_E56N_E100fF and (ii) the amino acid sequence of SEQ ID NO: 184, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 184, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 184, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 184, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 184, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 184, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 184, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 184, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 184, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 184, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 184, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 184, and a light chain consisting of the light chain amino acid sequence of P1-068767_D102V;

(fff) a heavy chain consisting of (i) the amino acid sequence of the VH of P1-068767_E55A and (ii) the amino acid sequence of SEQ ID NO: 184, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 184, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 184, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 184, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 184, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 184, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 184, and a light chain consisting of the light chain amino acid sequence of P1-068767_E55A_E100fF;

(mmm) a heavy chain consisting of (i) the amino acid sequence of the VH of P1-068767_D52N_E100fF and (ii) the amino acid sequence of SEQ ID NO: 184, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 184, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 184, and a light chain consisting of the light chain amino acid sequence of P1-068767_E30D_E100fF;

(ppp) a heavy chain consisting of (i) the amino acid sequence of the VH of P1-061029_F100fE_V102D and (ii) the amino acid sequence of SEQ ID NO: 184, and a light chain consisting of the light chain amino acid sequence of P1-061029_F100fE_V102D;

(qqq) a heavy chain consisting of (i) the amino acid sequence of the VH of P1-061029_F100fE and (ii) the amino acid sequence of SEQ ID NO: 184, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 184, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 184, and a light chain consisting of the light chain amino acid sequence of P1-061029_Y32E;

(ttt) a heavy chain consisting of (i) the amino acid sequence of the VH of P1-061029_Y32E_F100fE and (ii) the amino acid sequence of SEQ ID NO: 184, and a light chain consisting of the light chain amino acid sequence of P1-061029_Y32E_F100fE;

(uuu) a heavy chain consisting of (i) the amino acid sequence of the VH of P1-068744_E31S and (ii) the amino acid sequence of SEQ ID NO: 184, and a light chain consisting of the light chain amino acid sequence of P1-068744_E31S;

(vvv) a heavy chain consisting of (i) the amino acid sequence of the VH of P1-068744_H50I and (ii) the amino acid sequence of SEQ ID NO: 184, and a light chain consisting of the light chain amino acid sequence of P1-068744_H50I;

(www) a heavy chain consisting of (i) the amino acid sequence of the VH of P1-068744_E59Y and (ii) the amino acid sequence of SEQ ID NO: 184, and a light chain consisting of the light chain amino acid sequence of P1-068744_E59Y;

(xxx) a heavy chain consisting of (i) the amino acid sequence of the VH of P1-068744_E100S and (ii) the amino acid sequence of SEQ ID NO: 184, and a light chain consisting of the light chain amino acid sequence of P1-068744_E100S;

(yyy) a heavy chain consisting of (i) the amino acid sequence of the VH of P1-068744_E102Y and (ii) the amino acid sequence of SEQ ID NO: 184, and a light chain consisting of the light chain amino acid sequence of P1-068744_E102Y;

(zzz) a heavy chain consisting of (i) the amino acid sequence of the VH of P1-068744_E31S_H50I and (ii) the amino acid sequence of SEQ ID NO: 184, and a light chain consisting of the light chain amino acid sequence of P1-068744_E31S_H50I;

(aaaa) a heavy chain consisting of (i) the amino acid sequence of the VH of P1-068744_H50I_E59Y and (ii) the amino acid sequence of SEQ ID NO: 184, and a light chain consisting of the light chain amino acid sequence of P1-068744_H50I_E59Y;

(bbbb) a heavy chain consisting of (i) the amino acid sequence of the VH of P1-068744_E59Y_E100S and (ii) the amino acid sequence of SEQ ID NO: 184, and a light chain consisting of the light chain amino acid sequence of P1-068744_E5;9Y_E100S;

(cccc) a heavy chain consisting of (i) the amino acid sequence of the VH of P1-068744_E100S_E102Y and (ii) the amino acid sequence of SEQ ID NO: 184, and a light chain consisting of the light chain amino acid sequence of P1-068744_E100S_E102Y;

(dddd) a heavy chain consisting of (i) the amino acid sequence of the VH of P1-068744_E31S_E102Y and (ii) the amino acid sequence of SEQ ID NO: 184, and a light chain consisting of the light chain amino acid sequence of P1-068744_E31S_E102Y;

(eeee) a heavy chain consisting of (i) the amino acid sequence of the VH of P1-068744_E31S_E59Y and (ii) the amino acid sequence of SEQ ID NO: 184, and a light chain consisting of the light chain amino acid sequence of P1-068744_E31S_E59Y;

(ffff) a heavy chain consisting of (i) the amino acid sequence of the VH of P1-068744_E31S_E100S and (ii) the amino acid sequence of SEQ ID NO: 184, and a light chain consisting of the light chain amino acid sequence of P1-068744_E31S_E100S;

(gggg) a heavy chain consisting of (i) the amino acid sequence of the VH of P1-068744_H50I_E100S and (ii) the amino acid sequence of SEQ ID NO: 184, and a light chain consisting of the light chain amino acid sequence of P1-068744_H50I_E100S;

(hhhh) a heavy chain consisting of (i) the amino acid sequence of the VH of P1-068744_H50I_E102Y and (ii) the amino acid sequence of SEQ ID NO: 184, and a light chain consisting of the light chain amino acid sequence of P1-068744_H50I_E102Y;

(iiii) a heavy chain consisting of (i) the amino acid sequence of the VH of P1-068744_E59Y_E102Y and (ii) the amino acid sequence of SEQ ID NO: 184, and a VL and a light chain consisting of the light chain amino acid sequence of P1-068744_E59Y_E102Y;

(jjjj) a heavy chain consisting of (i) the amino acid sequence of the VH of P1-068748_H31S and (ii) the amino acid sequence of SEQ ID NO: 184, and a light chain consisting of the light chain amino acid sequence of P1-068748_H31S;

(kkkk) a heavy chain consisting of (i) the amino acid sequence of the VH of P1-068748_H32Y and (ii) the amino acid sequence of SEQ ID NO: 184, and a light chain consisting of the light chain amino acid sequence of P1-068748_H32Y;

(llll) a heavy chain consisting of (i) the amino acid sequence of the VH of P1-068748_D57K and (ii) the amino acid sequence of SEQ ID NO: 184, and a light chain consisting of the light chain amino acid sequence of P1-068748_D57K;

(mmmm) a heavy chain consisting of (i) the amino acid sequence of the VH of P1-068748_D58Y and (ii) the amino acid sequence of SEQ ID NO: 184, and a light chain consisting of the light chain amino acid sequence of P1-068748_D58Y;

(nnnn) a heavy chain consisting of (i) the amino acid sequence of the VH of P1-068748_D100S and (ii) the amino acid sequence of SEQ ID NO: 184, and a light chain consisting of the light chain amino acid sequence of P1-068748_D100S;

(oooo) a heavy chain consisting of (i) the amino acid sequence of the VH of P1-068748_H31S_H32Y and (ii) the amino acid sequence of SEQ ID NO: 184, and a light chain consisting of the light chain amino acid sequence of P1-068748_H31S_H32Y;

(pppp) a heavy chain consisting of (i) the amino acid sequence of the VH of P1-068748_H32Y_D57K and (ii) the amino acid sequence of SEQ ID NO: 184, and a light chain consisting of the light chain amino acid sequence of P1-068748_H32Y_D57K;

(qqqq) a heavy chain consisting of (i) the amino acid sequence of the VH of P1-068748_D57K_D58Y and (ii) the amino acid sequence of SEQ ID NO: 184, and a light chain consisting of the light chain amino acid sequence of P1-068748_D57K_D58Y;

(rrrr) a heavy chain consisting of (i) the amino acid sequence of the VH of P1-068748_D58Y_D100S and (ii) the amino acid sequence of SEQ ID NO: 184, and a light chain consisting of the light chain amino acid sequence of P1-068748_D58Y_D100S;

(ssss) a heavy chain consisting of (i) the amino acid sequence of the VH of P1-068748_H31S_D57K and (ii) the amino acid sequence of SEQ ID NO: 184, and a light chain consisting of the light chain amino acid sequence of P1-068748_H31S_D57K;

(tttt) a heavy chain consisting of (i) the amino acid sequence of the VH of P1-068748_H31S_D58Y and (ii) the amino acid sequence of SEQ ID NO: 184, and a light chain consisting of the light chain amino acid sequence of P1-068748_H31S_D58Y;

(uuuu) a heavy chain consisting of (i) the amino acid sequence of the VH of P1-068748_H31S_D100S and (ii) the amino acid sequence of SEQ ID NO: 184, and a light chain consisting of the light chain amino acid sequence of P1-068748_H31S_D100S;

(vvvv) a heavy chain consisting of (i) the amino acid sequence of the VH of P1-068748_H32Y_D58Y and (ii) the amino acid sequence of SEQ ID NO: 184, and a light chain consisting of the light chain amino acid sequence of P1-068748_H32Y_D58Y;

(wwww) a heavy chain consisting of (i) the amino acid sequence of the VH of P1-068748_H32Y_D100S and (ii) the amino acid sequence of SEQ ID NO: 184, and a light chain consisting of the light chain amino acid sequence of P1-068748_H32Y_D100S; or (xxxx) a heavy chain consisting of (i) the amino acid sequence of the VH of P1-068748_D57K_D100S and (ii) the amino acid sequence of SEQ ID NO: 184, and a light chain consisting of the light chain amino acid sequence of P1-068748_D57K_D100S, wherein the C-terminal amino acid of VH and the N-terminal amino acid of SEQ ID NO: 184 form a peptidic bond; and optionally wherein the VH in any of (a) or (c) to (ttt) comprises one or both of the K16R and T84A substitutions, and optionally wherein the VL of any of (b) or (uuu) to (xxxx) comprises a T85V substitution.

In some embodiments, the disclosure contemplates anti-VISTA mAbs comprising:

a heavy chain consisting of the amino acid sequences of (i) a VH of (a) to (xxxx) listed above, (ii) SEQ ID NO: 184, and (iii) a Lys residue, wherein the C-terminal amino acid of VH and the N-terminal amino acid of SEQ ID NO: 184 form a peptidic bond and wherein the C-terminal amino acid of SEQ ID NO: 184 is joined to the N-terminal of the Lys; and a light chain consisting of the light chain amino acid sequence of (a) to (xxxx) listed above;

wherein the VH and light chain amino acid sequences are chosen from the same antibody species from among (a) to (xxxx) listed above.

In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061029, wherein the antibody comprises a VH CDR1, CDR2, and/or CDR3 of P1-061029 in which at least one residue has been substituted with a D, an E, or an H. In some embodiments, each of the VH CDR1, CDR2, and CDR3 of P1-061029 contains one, two, or three residues substituted with a D, E, or H. In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061029, wherein the antibody comprises a VH CDR1 comprising one or two D or E residues at amino acid positions 4, 5, or 7 of CDR1, and/or comprises a VH CDR2 with one, two, or three D, E, or H residues at positions 3, 5, 6, or 7 of CDR2, and/or a VH CDR3 with one, two, or three D, E, or H residues at positions 6, 12, or 14 of CDR 3. (See Table 5 below for examples of antibodies falling within these embodiments.) In some embodiments, each of the VH CDR1, CDR2, and CDR3 of P1-061015 contains one, two, or three residues substituted with a D, E, or H. In some embodiments, an anti-h VISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061015, wherein the antibody comprises a VH CDR1 comprising one or two D or E residues at amino acid positions 4, 5, 6, or 7 of CDR1 such as an H or E residue at position 5 and/or an H residue at position 5 and/or 6, and/or comprises a VH CDR2 with one, two, or three D, E, or H residues at positions 1, 5, 9, and/or 10 of CDR2 such as at 1 and 9 or 10 or at 9 and/or 10, and/or a VH CDR3 with one, two, or three D, E, or H residues at positions 6 and/or 12 of CDR 3. In such cases, the light chain variable region may comprise the CDR1, CDR2, and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, and/or the light chain variable region may be at least 90%, at least 91%, at least 92%, at least 93%, at least 94%, at least 95%, at least 96%, at least 97%, at least 98%, or at least 99% identical to that of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061015, wherein the antibody comprises a VH CDR1, CDR2, and/or CDR3 of P1-061015 in which at least one residue has been substituted with a D, an E, or an H. In some embodiments, each of the VH CDR1, CDR2, and CDR3 of P1-061015 contains one, two, or three residues substituted with a D, E, or H. In some embodiments, an anti-h VISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061015, wherein the antibody comprises a VH CDR1 comprising one or two D, E, or H residues at amino acid positions 6, 7, 8, and 9 of CDR1, and/or comprises a VH CDR2 with one, two, or three D, E, or H residues at positions 1, 2, 4, or 8-11 of CDR2, and/or a VH CDR3 with one, two, or three D, E, or H residues at positions 2, 3, 6, 7, or 12 of CDR 3. (See Table 6 below for examples of antibodies falling within these embodiments.) In such cases, the light chain variable region may comprise the CDR1, CDR2, and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S and/or the light chain variable region may be at least 90%, at least 91%, at least 92%, at least 93%, at least 94%, at least 95%, at least 96%, at least 97%, at least 98%, or at least 99% identical to that of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

In some embodiments, such modified anti-hVISTA P1-061029 or P1-061015 progeny possess one or more of the following characteristics:

- specifically binding to hVISTA, e.g., histidine rich region of the ECD or a polypeptide comprising amino acid residues 35-127 of SEQ ID NO: 2, at acidic pH, e.g., pH 6.0 or pH 6.5;
- lacking of significant binding to hVISTA, e.g., histidine rich region of the ECD or a polypeptide comprising amino acid residues 35-127 of SEQ ID NO: 2, at physiological pH or neutral pH, e.g., pH 7.4 or pH 7.0;
- specifically binding to cyno VISTA, e.g., histidine rich region of the ECD, at acidic pH, e.g., pH 6.0 or pH 6.5;
- lacking of significant binding to cyno VISTA, e.g., histidine rich region of the ECD, at physiological pH or neutral pH, e.g., pH 7.4 or pH 7.0;
- having reduced binding to h VISTA-ECD having a substitution at one or more of the following amino acids: T35, Y37, K38, T39, Y41, R54, T61, F62, Q63, L65, H66, L67, H68, H69, F97, L115, V117, I119, H121, H122, S124, E125, R127 relative to hVISTA ECD having SEQ ID NO: 2;
- cross-competing for binding to hVISTA with P1-061029, P1-068761, P1-068767, P1-061015, P1-068744, and/or P1-068748;
- inhibiting binding of hVISTA to human T cells expressing VISTA (e.g., naïve or activated T cells) at acidic pH e.g., pH 6.0 or pH 6.5;
- inhibiting binding of h VISTA to PSGL-1 at acidic pH e.g., pH 6.0 or pH 6.5 (e.g., inhibiting the interaction between H153 and H154 of hVISTA having SEQ ID NO: 1 and PSGL-1 tyrosines Y46 and Y48), wherein PSGL-1 is with or without siayl lewis X, and wherein the tyrosines are preferably sulfotyrosines;
- inhibiting binding of hVISTA to VSIG-3;
- a mean residence time (MRT) of at least 100, 200, 300, 350, 400, 450, 500, 600 or 700 hours (e.g., at least 350 hours) in cynomolgus monkeys, measured, e.g, as described in the Examples;
- stimulating T cell activation by, e.g., enhancing T cell proliferation; enhancing IFN-γ production from T cells; and/or stimulating T cell receptor mediated NF-kB signaling;
- inhibiting VISTA mediated cell: cell adhesion;
- specifically binding to hVISTA in samples of human tumor cells or samples of inflamed human tissue that express VISTA;
- contacting hVISTA through one or more (e.g., at least 1-3, 1-5, 1-10, 5-10, 5-15 or all) energetically important contact residues Y37, T39, R54, F62, H66, V117, I119 or S124 (Table 21), as determined, e.g., using the yeast surface display and NGS assay described in the Examples; and wherein numbering is that of mature hVISTA (SEQ ID NO: 2);
- binding to Region 1: $_{57}$LGPVDKGHDVTF $_{68}$ (SEQ ID NO: 566); Region 2: $_{86}$RRPIRNLTFQDL$_{97}$ (SEQ ID NO: 567); and Region 3: $_{148}$VVEIRHHHSEH-RVHGAME $_{165}$ (SEQ ID NO: 568) of h VISTA having SEQ ID NO: 1, and optionally wherein the binding is strongest to Region 2, as determined by MS-HDX as described in the Examples;
- binding to the histidine-rich β-sheet extension of hVISTA, as determined, e.g., by crystallography, as described, e.g., in the Examples;
- contacting H121, H122 and/or H123 of mature hVISTA (distance of 4.0 Ångströms (Å) or less), such as through hydrogen bonds, as determined, e.g., by crystallography, as described, e.g., in the Examples;
- contacting hVISTA through at least one or more glutamic acid, aspartic acid or histidine residue that is located in VH CDR1, CDR2 or CDR3;
- accumulates preferably in tumor tissues in human VISTA knock-in mice harboring MC38 tumors in comparison to myeloid cells, in comparison to blood, and/or in comparison to liver, lung and spleen cells, as described in the Examples;
- accumulates preferably in tumors of patients in comparison to myeloid cells, in comparison to blood, and/or in comparison to liver, lung and spleen cells (e.g. detected for example by administering Ab labeled with a PET tracer);
- specifically binding to hVISTA under acidic conditions (e.g. at a pH of 6.5 with a $K_D$ (and/or koff) that is at least 10 fold, 100 fold, or 1000 fold lower than its $K_D$ or koff of binding to hVISTA under neutral or physiological pH as determined by surface plasmon resonance (SPR) as described in Example 30 herein;

inhibits binding of hVISTA to a cell to which hVISTA binds (e.g. a cell expressing PSGL-1), wherein binding is determined according to the protocol described in Example 31 herein (optionally wherein the cell is a human leukocyte, PBMC, or T cell);

blocks or cross-blocks binding of any one of the antibodies described herein as determined using competitive SPR epitope binning as described in Example 32 herein; and any additional characteristic set forth in the claims and/or in the Examples.

Exemplary Antibody Constant Regions

In some embodiments, an antibody described herein comprises one or more human constant regions. In some embodiments, the human heavy chain constant region is of an isotype selected from IgA, IgG, and IgD. In some embodiments, the human light chain constant region is of an isotype selected from k and 2. In some embodiments, an antibody described herein comprises a human IgG constant region, such as an IgG1, IgG2, IgG3, or IgG4. In some embodiments, an antibody described herein comprises a human IgG4 heavy chain constant region. In some such embodiments, an antibody described herein comprises an S241P mutation in the human IgG4 constant region. In some embodiments, an antibody described herein comprises a human IgG4 constant region and a human k light chain.

The choice of heavy chain constant region can determine whether or not an antibody will have effector function in vivo. Such effector function, in some embodiments, includes antibody-dependent cell-mediated cytotoxicity (ADCC) and/or complement-dependent cytotoxicity (CDC), and can result in killing of the cell to which the antibody is bound. In some methods of treatment, including methods of treating some cancers, cell killing may be desirable, for example, when the antibody binds to a cell that supports the maintenance or growth of the tumor. Exemplary cells that may support the maintenance or growth of a tumor include, but are not limited to, tumor cells themselves, cells that aid in the recruitment of vasculature to the tumor, and cells that provide ligands, growth factors, or counter-receptors that support or promote tumor growth or tumor survival. In some embodiments, when effector function is desirable, an antibody comprising a human IgG1 heavy chain or a human IgG3 heavy chain is selected.

In certain embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the invention may be made in order to create antibodies with certain improved properties. For example, in some embodiments an antibody may be afucosylated, for example, by mutating residues such as Asn297 that are normally glycosylated with fucose-containing glycosylations, or through other means. In some embodiments, antibodies herein may comprise an afucosylated human IgG1 constant region.

Antibodies are further provided with bisected oligosaccharides, e.g., in which a biantennary oligosaccharide attached to the Fc region of the antibody is bisected by GlcNAc. Such antibodies may have reduced fucosylation and/or improved ADCC function. Examples of such antibodies are described, e.g., in WO 2003/011878 (Jean-Mairet et al.); U.S. Pat. No. 6,602,684 (Umana et al.); and US 2005/0123546 (Umana et al.). Antibodies with at least one galactose residue in the oligosaccharide attached to the Fc region are also provided. Such antibodies may have improved CDC function. Such antibodies are described, e.g., in WO 1997/30087 (Patel et al.); WO 1998/58964 (Raju, S.); and WO 1999/22764 (Raju, S.).

Antibodies are also provided with amino-terminal leader extensions. For example, one or more amino acid residues of the amino-terminal leader sequence are present at the amino-terminus of any one or more heavy or light chains of an antibody. An exemplary amino-terminal leader extension comprises or consists of three amino acid residues, VHS, present on one or both light chains of an antibody.

The in vivo or serum half-life of human FcRn high affinity binding polypeptides can be assayed, e.g., in transgenic mice, in humans, or in non-human primates to which the polypeptides with a variant Fc region are administered. See also, e.g., Petkova et al. *International Immunology* 18(12): 1759-1769 (2006).

In some embodiments of the invention, an afucosylated antibody mediates ADCC in the presence of human effector cells more effectively than a parent antibody that comprises fucose, Generally, ADCC activity may be determined using the in vitro ADCC assay as herein disclosed, but other assays or methods for determining ADCC activity, e.g. in an animal model etc., are contemplated.

In certain embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320, 322, 330, and/or 331 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In some examples, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In some examples, one or more amino acid residues within amino acid positions 231 and 239 are altered to thereby alter the ability of the antibody to fix complement. This approach is described further in PCT Publication WO 94/29351 by Bodmer et al. In some examples, the Fc region can be modified to decrease antibody dependent cellular cytotoxicity (ADCC) and/or to decrease the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other Fc modifications that can be made to Fcs are those for reducing or ablating binding to FcγR and/or complement proteins, thereby reducing or ablating Fc-mediated effector functions such as ADCC, ADCP, and CDC. Exemplary modifications include but are not limited substitutions, insertions, and deletions at positions 234, 235, 236, 237, 267, 269, 325, 328, 330, and/or 331 (e.g., 330 and 331), wherein numbering is according to the EU index. Exemplary substitutions include but are not limited to 234A, 235E, 236R, 237A, 267R, 269R, 325L, 328R, 330S, and 331S (e.g., 330S, and 331S), wherein numbering is according to the EU index. An Fc variant can comprise 236R/328R. Other modifications for reducing FcγR and complement interactions include substitutions 297A, 234A, 235A, 237A, 318A, 228P, 236E, 268Q, 309L, 330S, 331 S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, Current Opinion in Biotechnology 20:685-691. For example, the human IgG1.3 Fc constant region contains L234A, L235E, and G237A substitutions. The IgG1fa.P238K (or IgG1.P238K) contains a P238K substitution. The IgG1. If comprises L234A, L235E, G237A, A330S, and P331S substitutions.

Fc variants that enhance affinity for an inhibitory receptor FcγRIIb can also be used. Such variants can provide an Fc fusion protein with immunomodulatory activities related to FcγRIIb cells, including for example B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, 330, 331, and 332, according to the EU index. Exemplary substitutions for enhancing FcγRIIb affinity include but are not limited to 234A, 234D, 234E, 234F, 234W, 235D, 235E, 235F, 235R, 235Y, 236D, 236N, 237A, 237D, 237N, 239D, 239E, 266M, 267D, 267E, 268D, 268E, 327D, 327E, 328F, 328W, 328Y, 330S, 331S, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 236D/267E, 239D/268D, 239D/267E, 267E/268D, 267E/268E, and 267E/328F.

Other modifications for enhancing FcγR and complement interactions include but are not limited to substitutions 298 A, 333A, 334A, 326A, 2471, 339D, 339Q, 280H, 290S, 298D, 298V, 243L, 292P, 300L, 396L, 3051, and 396L. These and other modifications are reviewed in Strohl, 2009, Current Opinion in Biotechnology 20:685-691. Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in Patent Publication No. WO 00/42072.

Optionally, the Fc region can comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; PCX Patent Publications WO 00/42072; WO 01/58957; WO 02/06919; WO 04/016750; WO 04/029207; WO 04/035752; WO 04/074455; WO 04/099249; WO 04/063351; WO 05/070963; WO 05/040217, WO 05/092925 and WO 06/0201 14).

The affinities and binding properties of an Fc region for its ligand can be determined by a variety of in vitro assay methods (biochemical or immunological based assays) known in the art including but not limited to, equilibrium methods (e.g., enzyme-linked immunoabsorbent assay (ELISA), or radioimmunoassay (RIA)), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods can utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental immunology, 4th Ed., Lippincott-Raven, Philadelphia (1999), which focuses on antibody-immunogen interactions.

In certain embodiments, the antibody is modified to increase its biological half-life. Various approaches are possible. For example, this can be done by increasing the binding affinity of the Fc region for FcRn, For example, one or more of more of following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 2591, 308F, 428L, 428M, 434S, 4341 1. 434F, 434Y, and 434X1. Other variants that increase Fc binding to FcRn include: 250E, 250Q, 428 L, 428F, 250Q/428L (Hinton et al. 2004, *J. Biol. Chem.* 279(8): 6213-6216, Hinton et al. 2006 *Journal of Immunology* 176:346-356), 256A, 272A, 286A, 305A, 307A, 307Q, 31 1A, 312A, 376A, 378Q, 380A, 382A, 434A (Shields et al., *Journal of Biological Chemistry,* 2001, 276(9): 6591-6604), 252F, 252T, 252Y, 252W, 254T, 256S, 256R, 256Q, 256E, 256D, 256T, 309P, 31 1 S, 433R, 433S, 4331, 433P, 433Q, 434H, 434F, 434Y, 252Y/254T/256E, 433K/434F/436H, 308T/309P/311S (Dall Acqua et al. *Journal of Immunology,* 2002, 169:5171-5180, Dall'Acqua et al., 2006, *Journal of Biological Chemistry* 281:23514-23524). Other modifications for modulating FcRn binding are described in Yeung et al., 2010, *J Immunol,* 182:7663-7671.

In certain embodiments, hybrid IgG isotypes with particular biological characteristics can be used. For example, an IgG1/IgG3 hybrid variant can be constructed by substituting IgG1 positions in the CH2 and/or CH3 region with the amino acids from IgG3 at positions where the two isotypes differ. Thus a hybrid variant IgG antibody can be constructed that comprises one or more substitutions, e.g., 274Q, 276K, 300F, 339T, 356E, 358M, 384S, 392N, 397M, 4221, 435R, and 436F. In some embodiments described herein, an IgG1/IgG2 hybrid variant can be constructed by substituting IgG2 positions in the CH2 and/or CH3 region with amino acids from IgG1 at positions where the two isotypes differ. Thus a hybrid variant IgG antibody can be constructed that comprises one or more substitutions, e.g., one or more of the following amino acid substitutions: 233E, 234L, 235L, −236G (referring to an insertion of a glycine at position 236), and 327A.

Moreover, the binding sites on human IgG1 for FcγRI, FcγRII, FcγRIII and FcRn have been mapped and variants with improved binding have been described (see Shields, R. L. et al. (2001) *J. Biol. Chem.* 276:6591-6604). Specific mutations at positions 256, 290, 298, 333, 334 and 339 were shown to improve binding to FcγRIII. Additionally, the following combination mutants were shown to improve FcγRIII binding: T256A/S298A, S298A/E333A, S298A/K224A and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/1332E and S239D/1332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/1332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that can be used include: S298A/E333A/L334A, S239D/1332E, S239D/1332E/A330L, L235V/F243L/R292P/Y300L/P396L, and M428L/N434S.

In certain embodiments, an Fc is chosen that has reduced binding to FcγRs. An exemplary Fc, e.g., IgG1 Fc, with reduced FcγR binding comprises the following three amino acid substitutions: L234A, L235E and G237A.

In certain embodiments, an Fc is chosen that has reduced complement fixation. An exemplary Fc, e.g., IgG1 Fc, with reduced complement fixation has the following two amino acid substitutions: A330S and P331S.

In certain embodiments, an Fc is chosen that has essentially no effector function, i.e., it has reduced binding to FcγRs and reduced complement fixation. An exemplary Fc, e.g., IgG1 Fc, that is effectorless comprises the following five mutations: L234A, L235E, G237A, A330S and P331S.

When using an IgG4 constant domain, it can include the substitution S228P, which mimics the hinge sequence in IgG1 and thereby stabilizes IgG4 molecules.

Fc modifications described in WO 2017/087678 or WO2016081746 may also be used.

In certain embodiments, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation can increase the affinity of the antibody for antigen. Such an approach is described in further detail in U.S. Pat. Nos. 5,714,350 and 6,350,861 by Co et al.

Glycosylation of the constant region on N297 can be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Led 3 cells, with reduced ability to attach fucose to Asn (297)-linked carbohydrates, also resulting in hypofucosylation of antibodies expressed in that host cell (see also Shields, R. L. et al. (2002) *J. Biol. Chem.* 277:26733-26740). PCT Publication WO 99/54342 by Umana et al. describes cell lines engineered to express glycoprotein-modifying glycosyl transferases {e.g., beta (1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17:176-180).

Another modification of the antibodies described herein is pegylation. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. In some embodiments, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies described herein. See for example, EP 0 154 316 by Nishimura et al. and EP 0 401 384 by Ishikawa et al.

In various embodiments, an antibody binding to VISTA described herein is modified to selectively block antigen binding in tissues and environments where antigen binding would be detrimental, but allow antigen binding where it would be beneficial ("activatable antibody"). In one embodiment, a blocking peptide "mask" is generated that specifically binds to the antigen binding surface of the antibody and interferes with antigen binding, which mask is linked to each of the binding arms of the antibody by a peptidase cleavable linker. See, e.g., U.S. Pat. No. 8,518,404 to CytomX. Such constructs are useful for treatment of cancers in which protease levels are greatly increased in the tumor microenvironment compared with non-tumor tissues. Selective cleavage of the cleavable linker in the tumor microenvironment allows disassociation of the masking/blocking peptide, enabling antigen binding selectively in the tumor, rather than in peripheral tissues in which antigen binding might cause unwanted side effects. Examples of blocking peptides linked to antibodies are provided in WO 2018/08555.

Alternatively, in a related embodiment, a bivalent binding compound ("masking ligand") comprising two antigen binding domains is developed that binds to both antigen binding surfaces of the (bivalent) antibody and interfere with antigen binding, in which the two binding domains masks are linked to each other (but not the antibody) by a cleavable linker, for example cleavable by a peptidase. See, e.g., Int'l Pat. App. Pub. No. WO 2010/077643 to Tegopharm Corp. Masking ligands may comprise, or be derived from, the antigen to which the antibody is intended to bind, or may be independently generated. Such masking ligands are useful for treatment of cancers in which protease levels are greatly increased in the tumor microenvironment compared with non-tumor tissues. Selective cleavage of the cleavable linker in the tumor microenvironment allows disassociation of the two binding domains from each other, reducing the avidity for the antigen-binding surfaces of the antibody. The resulting dissociation of the masking ligand from the antibody enables antigen binding selectively in the tumor, rather than in peripheral tissues in which antigen binding might cause unwanted side effects.

Nucleic Acids and Host Cells

Also provided are nucleic acids encoding an antibody or a heavy or light chain thereof or a portion thereof. Exemplary nucleic acids are provided in the Sequence Table. Any nucleic acid that is at least 80%, 85%, 90%, 95%, 97%, 98% or 99% to a nucleic acid in the Sequence Table is encompassed herein. Compositions comprising nucleic acids encoding an antibody provided herein are also encompassed, as are cells comprising these and methods for preparing antibodies, comprising culturing a cell transformed with a nucleic acid encoding an anti-VISTA antibody, and isolating the antibody from the medium or the cell.

Methods of Treatment using VISTA-ECD Binding Abs and Related Pharmaceutical Compositions In certain embodiments, an anti-VISTA antibody that binds to VISTA at low pH and, e.g., lacks significant binding at neutral or physiological pH, can be a VISTA antagonist antibody, i.e., an antibody that inhibits the action of VISTA, such that an immune response is stimulated. Such antibodies may be used for treating diseases in which stimulating the immune system or an immune response is desired, such as proliferative diseases (benign or malignant), cancer, and infectious diseases (e.g., viral infections).

In certain embodiments, an anti-VISTA antibody that binds to VISTA at low pH and, e.g., lacks significant binding at neutral or physiological pH can be a VISTA agonist antibody, i.e., an antibody that increases the action of VISTA, such that an immune response is inhibited. Such antibodies may be used for treating diseases in which inhibition of the immune system or an immune response is desired, such as autoimmune diseases and inflammatory conditions, such as rheumatoid arthritis, systemic lupus erythematosus, celiac disease, Sjoigren's syndrome, Grave's disease, inflammatory bowel disease, psoriasis, ankylosing spondylitis, graft versus host disease, allergy, and asthma.

The antibodies described herein may be used, for example, for treating cancer. In some embodiments, methods for treating cancer are provided, comprising administering an effective amount of an antibody described herein to a patient. In some embodiments, the Abs may trigger or enhance an immune response in the patient, such as an antigen-specific immune response. In some embodiments, the Abs may stimulate T cell activity. In some embodiments, the Abs may inhibit the growth of at least one tumor in the patient.

Provided herein are methods for treating a subject having cancer, comprising administering to the subject a therapeutically effective amount of an anti-VISTA antibody described herein, such that the subject is treated. An anti-VISTA antibody can be used alone. Alternatively, an anti-VISTA antibody can be used in conjunction with another agent, as described further below.

Examples of cancers that may be treated with an Ab specifically binding to a VISTA-ECD protein under acidic conditions as described herein include but are not limited to, carcinoma, lymphoma, blastoma, sarcoma, and leukemia. Cancers that may be treated with an Ab described herein also include cancers typically responsive to immunotherapy and those that are not typically responsive to immunotherapy. Cancers that can be treated also include VISTA positive cancers, e.g., cancers having VISTA positive tumor infiltrating cells, e.g., lymphocytes, myeloid or monocytic cells. Cancers can be cancers with solid tumors or blood malignancies (liquid tumors).

Non-limiting examples of cancers for treatment include squamous cell carcinoma, small-cell lung cancer, non-small cell lung cancer, squamous non-small cell lung cancer (NSCLC), nonsquamous NSCLC, glioma, gastrointestinal cancer, renal cancer (e.g., clear cell carcinoma), ovarian cancer, liver cancer, colorectal cancer, endometrial cancer, kidney cancer (e.g., renal cell carcinoma (RCC)), prostate cancer (e.g., hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T-cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (MO), myeloblastic leukemia (Ml), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein can also be used for treatment of metastatic cancers, unresectable, refractory cancers (e.g., cancers refractory to previous immunotherapy, e.g., with a blocking CTLA-4 or PD-1 antibody), and/or recurrent cancers.

In some embodiments, methods of treating cancer are provided, wherein the methods comprise administering an isolated antibody that binds specifically to huVISTA in acidic conditions as described herein to a subject with cancer. In some embodiments, use of an antibody described herein for treating cancer is provided.

In certain embodiments, an antibody described herein is administered to patients having a cancer that has exhibited an inadequate response to, or progressed on, a prior treatment, e.g., a prior treatment with an immuno-oncology or immunotherapy drug. In some embodiments, the cancer is refractory or resistant to a prior treatment, either intrinsically refractory or resistant (e.g., refractory to a PD-1 pathway antagonist), or a resistance or refractory state is acquired. For example, an antibody described herein may be administered to subjects who are not responsive or not sufficiently responsive to a first therapy or who have disease progression following treatment, e.g., anti-PD-1 pathway antagonist treatment, either alone or in combination with another therapy (e.g., with an anti-PD-1 pathway antagonist therapy). In other embodiments, an antibody described herein is administered to patients who have not previously received (i.e., been treated with) an immuno-oncology agent, e.g., a PD-1 pathway antagonist.

In certain embodiments, a method of treating cancer in a subject comprises first determining the tumor mutational burden (TMB) of a tumor in a subject, and administering an anti-VISTA antibody based on the results, e.g., to subjects found to have a high TMB.

Combinations with Immune Stimulating Agents

In some embodiments, an antibody as described herein, e.g., an antagonist VISTA antibody described herein, is administered in combination with and at least one immune stimulating agent. For example, the therapeutics may be infused together or injected at roughly the same time. In some embodiments, the antibody and the at least one immune stimulating agent are administered sequentially. For example, in some embodiments the antibody is administered sequentially before or after at least one immune stimulating agent such that the two therapeutics are administered 30 minutes, 60 minutes, 90 minutes, 120 minutes, 3 hours, 6 hours, 12 hours, 24 hours, 36 hours, 48 hours, 3 days, 5 days, 7 days, or two weeks apart.

In some embodiments, at least one, at least two, at least three doses, at least five doses, or at least ten doses of the antibody is administered prior to administration of at least one immune stimulating agent. In some embodiments, at least one, at least two, at least three doses, at least five doses, or at least ten doses of at least one immune stimulating agent is administered prior to administration of the antibody. In some embodiments, the last dose of immune stimulating agent is administered at least one, two, three, five, days or ten, or one, two, three, five, twelve, or twenty four weeks prior to the first dose of the antibody. In some embodiments, the last dose of the antibody is administered at least one, two, three, five, days or ten, or one, two, three, five, twelve, or twenty four weeks prior to the first dose of at least one immune stimulating agent. In some embodiments, a subject has received, or is receiving, therapy with at least one immune stimulating agent and a VISTA-ECD-binding antibody is added to the therapeutic regimen.

In some embodiments, the at least one immune stimulating agent comprises an antagonist of an inhibitor of the activation of T cells, while in some embodiments, the at least one immune stimulating agent comprises an agonist of a stimulator of the activation of T cells. In some embodiments, the at least one immune stimulating agent comprises an antagonist of CTLA4, LAG-3, PD-1, PD-L1, Galectin 1, Galectin 9, CEACAM-1, BTLA, CD25, CD69, TIGIT, CD113, GPR56, VISTA, B7-H3, B7-H4, 2B4, CD48, GARP, PD1H, LAIR1, TIM1, TIM3, TIM4, ILT4, IL-6, IL-10, TGFβ, VEGF, KIR, LAG-3, adenosine A2A receptor, PI3Kdelta, or IDO. In some embodiments, the at least one immune stimulating agent comprises an agonist of B7-1, B7-2, CD28, 4-1BB (CD137), 4-1BBL, ICOS, ICOS-L, OX40, OX40L, GITR, GITRL, CD27, CD40, CD40L, DR3, CD28H, IL-2, IL-7, IL-12, IL-15, IL-21, IFNα, STING, or a Toll-like receptor agonist such as a TLR2/4 agonist. In some embodiments, the at least one immune stimulating agent comprises an agent that binds to another member of the B7 family of membrane-bound proteins such as B7-1, B7-2, B7-H2 (ICOS-L), B7-H3, B7-H4, and B7-H6. In some embodiments, the at least one immune stimulating agent comprises an agent that binds to a member of the TNF receptor family or a co-stimulatory or co-inhibitory molecule binding to a member of the TNF receptor family such as CD40, CD40L, OX40, OX40L, GITR, GITRL, CD70, CD27L, CD30, CD30L, 4-1BBL, CD137 (4-1BB), TRAIL/Apo2-L, TRAILR1/DR4, TRAILR2/DR5, TRAILR3, TRAILR4, OPG, RANK, RANKL, TWEAKR/Fn14, TWEAK, BAFFR, EDAR, XEDAR, EDA1, EDA2, TACI, APRIL, BCMA, LTβR, LIGHT, DeR3, HVEM, VEGL/TLIA, TRAMP/DR3, TNFR1, TNFβ, TNFR2, TNFα, 1B2, FAS, FASL, RELT, DR6, TROY, or NGFβ. In some embodiments, the at least one immune stimulating agent comprises an agent that antagonizes or inhibits a cytokine that inhibits T cell activation such as IL-6, IL-10, TGFβ, VEGF. In some embodiments, the at least one immune stimulating agent comprises an agonist of a cytokine that stimulates T cell activation such as IL-2, IL-7, IL-12, IL-15, IL-21, and IFNα. In some embodiments, the at least one immune stimulating agent comprises an antagonist of a chemokine, such as CXCR2, CXCR4, CCR2, or CCR4. In some embodiments, the at least one immune stimulating agent comprises an antibody. In some embodiments, the at least one immune stimulating agent may comprise a vaccine, such as a mesothelin-targeting vaccine or attenuated *listeria* cancer vaccine such as CRS-207.

For example, an anti-VISTA antibody described herein could be administered with one or more of the following agents:

(1) An antagonist (inhibitor or blocking agent) of a protein that inhibits T cell activation (e.g., immune checkpoint inhibitors), such as CTLA-4, PD-1, PD-L1, PD-L2, and LAG-3, Galectin 9, CEACAM-1, BTLA, CD69, Galectin-1, TIGIT, CD113, GPR56, B7-H3, B7-H4, 2B4, CD48, GARP, PD1H, LAIR1, TIM-1, TIM-3 and TIM-4; and/or (2) An agonist of a protein that stimulates T cell activation, such as B7-1, B7-2, CD28, 4-1BB (CD137), 4-1BBL, GITR, ICOS, ICOS-L, OX40, OX40L, CD70, CD27, CD40, DR3 and CD28H.

Exemplary agents that can be combined with anti-VISTA antibodies described herein for treating cancer include: YERVOY® (ipilimumab) or Tremelimumab (to CTLA-4), galiximab (to B7.1), BMS-936558 (to PD-1), MK-3475 (to PD-1), atezolizumab (TECENTRIQ®), Avelumab, Durvalumab, PDR001 (Novartis), AMP224 (to B7DC), BMS-936559 (to B7-H1), MPDL3280A (to B7-H1), MEDI-570 (to ICOS), AMG557 (to B7H2), MGA271 (to B7H3), IMP321 (to LAG-3), BMS-663513 (to CD137), PF-05082566 (to CD137), CDX-1127 (to CD27), anti-OX40 (Providence Health Services), huMAbOX40L (to OX40L), Atacicept (to TACI), CP-870893 (to CD40), Lucatumumab (to CD40), Dacetuzumab (to CD40), Muromonab-CD3 (to CD3); anti-GITR antibodies MK4166, TRX518, Medi1873, INBRX-110, LK2-145, GWN-323, GITRL-Fc, or any combination thereof.

Other molecules that can be combined with anti-VISTA antibodies for the treatment of cancer include antagonists of inhibitory receptors on NK cells or agonists of activating receptors on NK cells, for example, antagonists of KIR (e.g., lirilumab).

T cell activation may also be regulated by soluble cytokines. In some embodiments, anti-VISTA antibodies can be administered in combination with antagonists of cytokines that are intended to inhibit T cell activation or agonists of cytokines that stimulate T cell activation. For example, anti-VISTA antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-β, VEGF; "immunosuppressive cytokines") and/or (ii) agonists of stimulatory receptors of the IgSF family, B7 family or the TNF family or of cytokines that stimulate T cell activation.

Yet other agents for combination therapies include agents that inhibit or deplete macrophages or monocytes, including but not limited to CSF-1R antagonists such as CSF-1R antagonist antibodies including RG7155 (WO11/70024, WO11/107553, WO11/131407, WO13/87699, WO13/119716, WO13/132044) or FPA-008 (WO11/140249; WO13169264; WO14/036357).

Anti-VISTA antibodies can also be administered with agents that inhibit TGF-β signaling.

Additional agents that can be combined with an anti-VISTA antibody include agents that enhance tumor antigen presentation, e.g., dendritic cell vaccines, GM-CSF secreting cellular vaccines, CpG oligonucleotides, and imiquimod, or therapies that enhance the immunogenicity of tumor cells (e.g., anthracyclines).

Yet other therapies that can be combined with an anti-VISTA antibody include therapies that deplete or block Treg cells, e.g., an agent that specifically binds to CD25.

Another therapy that can be combined with an anti-VISTA antibody is a therapy that inhibits a metabolic enzyme such as indoleamine dioxigenase (IDO), dioxigenase, arginase, or nitric oxide synthetase.

Another class of agents that can be used with an anti-VISTA antibody includes agents that inhibit the formation of adenosine, e.g., CD73 inhibitors, or inhibit the adenosine A2A receptor.

Other therapies that can be combined with an anti-VISTA antibody for treating cancer include therapies that reverse/prevent T cell anergy or exhaustion and therapies that trigger an innate immune activation and/or inflammation at a tumor site.

Other therapies that can be combined with an anti-VISTA antibody for treating cancer include therapies that block IL-8, e.g., with HuMax®-IL8.

An anti-VISTA antibody can be combined with more than one immuno-oncology agent, and can be, e.g., combined with a combinatorial approach that is intended to target multiple elements of the immune pathway, such as one or more of the following: a therapy that enhances tumor antigen presentation (e.g., dendritic cell vaccine, GM-CSF secreting cellular vaccines, CpG oligonucleotides, imiquimod); a therapy that inhibits negative immune regulation e.g., by inhibiting CTLA-4 and/or PD1/PD-L1/PD-L2 pathway and/or depleting or blocking Tregs or other immune suppressing cells; a therapy that stimulates positive immune regulation, e.g., with agonists that stimulate the CD-137, OX-40, and/or CD40 or GITR pathway and/or stimulate T cell effector function; a therapy that increases systemically the frequency of anti-tumor T cells; a therapy that depletes or inhibits Tregs, such as Tregs in the tumor, e.g., using an antagonist of CD25 (e.g., daclizumab) or by ex vivo anti-CD25 bead depletion; a therapy that impacts the function of suppressor myeloid cells in the tumor; a therapy that enhances immunogenicity of tumor cells (e.g., anthracyclines); adoptive T cell or NK cell transfer including genetically modified cells, e.g., cells modified by chimeric antigen receptors (CAR-T therapy); a therapy that inhibits a metabolic enzyme such as indoleamine dioxigenase (IDO), dioxigenase, arginase, or nitric oxide synthetase; a therapy that reverses/prevents T cell anergy or exhaustion; a therapy that triggers an innate immune activation and/or inflammation at a tumor site; administration of immune stimulatory cytokines; or blocking of immuno repressive cytokines.

Anti-VISTA antibodies described herein can be used together with one or more of agonistic agents that ligate positive costimulatory receptors, blocking agents that attenuate signaling through inhibitory receptors, antagonists, and one or more agents that increase systemically the frequency of anti-tumor T cells, agents that overcome distinct immune suppressive pathways within the tumor microenvironment (e.g., block inhibitory receptor engagement (e.g., PD-L1/PD-1 interactions), deplete or inhibit Tregs (e.g., using an anti-CD25 monoclonal antibody (e.g., daclizumab) or by ex vivo anti-CD25 bead depletion), inhibit metabolic enzymes such as IDO, or reverse/prevent T cell anergy or exhaustion) and agents that trigger innate immune activation and/or inflammation at tumor sites.

In certain embodiments, an anti-VISTA antibody is administered to a subject together with a BRAF inhibitor if the subject is BRAF V600 mutation positive.

Suitable PD-1 antagonists for use in the combination therapy described herein, include, without limitation, ligands, antibodies (e.g., monoclonal antibodies and bispecific antibodies), and multivalent agents. In one embodiment, the PD-1 antagonist is a fusion protein, e.g., an Fc fusion protein, such as AMP-244. In one embodiment, the PD-1 antagonist is an anti-PD-1 or anti-PD-L1 antibody.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In certain embodiments, an anti-PD-1 antibody is MK-3475 (Lambrolizumab) described in WO2012/145493; AMP-514 described in WO 2012/145493; or PDR001. Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 can also be used. An anti-PD-1 antibody that competes for binding with, and/or binds to the same epitope on PD-1 as, as one of these antibodies can also be used in combination treatments.

In some embodiments, the anti-PD-L1 antibody useful for the combination therapy is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943,743. In certain embodiment an anti-PD-L1 antibody is MEDI4736 (also known as durvalumab and Anti-B7-H1), MPDL3280A (also known as atezolizumab and RG7446), MSB0010718C (also known as avelumab; WO2013/79174), or rHigM12B7. Any of the anti-PD-L1 antibodies disclosed in WO2013/173223, WO2011/066389, WO2012/145493, U.S. Pat. Nos. 7,635,757 and 8,217,149 and U.S. Publication No. 2009/145493 can also be used. Anti-PD-L1 antibodies that compete with and/or bind to the same epitope as that of any of these antibodies can also be used in combination treatments.

In certain embodiments, the anti-VISTA antibody of the disclosure can be used with a CTLA-4 antagonist, e.g., an anti-CTLA-4 antibody. In one embodiment, an anti-CTLA-4 antibody is an antibody selected from the group of: YERVOY® (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) *Pro. Natl. Acad. Sci. USA* 95(17): 10067-10071; Camacho et al. (2004) *J. Clin. Oncology* 22(145): Abstract No. 2505 (antibody CP-675206); and Mokyr et al. (1998) *Cancer Res.* 58:5301-5304. Any of the anti-CTLA-4 antibodies disclosed in WO2013/173223 can also be used.

In some embodiments, an anti-VISTA antibody of the disclosure is used in combination with a LAG3 antagonist. Examples of anti-LAG3 antibodies include antibodies comprising the CDRs or variable regions of antibodies 25F7, 26H10, 25E3, 8B7, 11F2 or 17E5, which are described in U.S. Patent Publication No. US2011/0150892, WO10/19570 and WO2014/008218. In one embodiment, an anti-LAG-3 antibody is BMS-986016. Other art recognized anti-LAG-3 antibodies that can be used include IMP731 and IMP-321, described in US 2011/007023, WO08/132601, and WO09/44273. Anti-LAG-3 antibodies that compete with and/or bind to the same epitope as that of any of these antibodies can also be used in combination treatments.

In some embodiments, an anti-VISTA antibody of the disclosure can be administered in combination with a CD137 (4-1BB) agonist, such as an agonistic CD137 antibody. Suitable CD137 antibodies include, for example, urelumab or PF-05082566 (WO12/32433).

In some embodiments, an anti-VISTA antibody can be administered in combination with an OX40 agonist, such as an agonistic OX40 antibody. Suitable OX40 antibodies include, for example, MEDI-6383, MEDI-6469 or MOXR0916 (RG7888; WO06/029879).

In one embodiment, an anti-VISTA antibody is administered in combination with a CD40 agonist, such as an agonistic CD40 antibody. In certain embodiments, the immuno-oncology agent is a CD40 antagonist, such as an antagonistic CD40 antibody. Suitable CD40 antibodies include, for example, lucatumumab (HCD122), dacetuzumab (SGN-40), CP-870,893 or Chi Lob 7/4.

In one embodiment, an anti-VISTA antibody is administered in combination with a CD27 agonist, such as an agonistic CD27 antibody. Suitable CD27 antibodies include, for example, varlilumab (CDX-1127).

In certain embodiments, the anti-VISTA antibody is administered together with an anti-GITR antibody, e.g., an antibody having the CDR sequences of 6C8, e.g., a humanized antibody having the CDRs of 6C8, as described, e.g., in WO2006/105021; an antibody comprising the CDRs of an anti-GITR antibody described in WO2011/028683; an antibody comprising the CDRs of an anti-GITR antibody described in JP2008278814, an antibody comprising the CDRs of an anti-GITR antibody described in WO2015/031667, WO2015/187835, WO2015/184099, WO2016/054638, WO2016/057841 or WO2016/057846 or other anti-GITR antibody described or referred to herein.

In some embodiments, an anti-VISTA antibody is administered in combination with MGA271 (to B7H3) (WO11/109400).

In some embodiments, an anti-VISTA antibody is administered in combination with a KIR antagonist, such as lirilumab.

In some embodiments, an anti-VISTA antibody is administered in combination with an IDO antagonist. Suitable IDO antagonists include, for example, INCB-024360 (WO2006/122150, WO07/75598, WO08/36653, WO08/36642), indoximod, NLG-919 (WO09/73620, WO09/1156652, WO11/56652, WO12/142237) or F001287.

In some embodiments, an anti-VISTA antibody is administered in combination with a Toll-like receptor agonist, e.g., a TLR2/4 agonist (e.g., Bacillus Calmette-Guerin); a TLR7 agonist (e.g., Hiltonol or Imiquimod); a TLR7/8 agonist (e.g., Resiquimod); or a TLR9 agonist (e.g., CpG7909).

In one embodiment, an anti-VISTA is administered in combination with a TGF-β inhibitor, e.g., GC1008, LY2157299, TEW7197, or IMC-TR1.

In certain embodiments, an anti-VISTA agent, e.g., an antibody is administered with an anti-PSGL-1 antibody.

Additional Combination Therapy

The Abs herein may also be provided before, substantially contemporaneous with, or after other modes of treatment, for example, surgery, chemotherapy, radiation therapy, or the administration of a biologic, such as another therapeutic antibody. In some embodiments, the cancer has recurred or progressed following a therapy selected from surgery, chemotherapy, and radiation therapy, or a combination thereof. For example, an anti-VISTA antibody as described herein could be administered as adjunctive therapy when there is a risk that micrometastases can be present and/or in order to reduce the risk of a relapse.

For treatment of cancer, the combinations may be administered in conjunction with one or more additional anti-cancer agents, such as a chemotherapeutic agent, growth inhibitory agent, anti-cancer vaccine such as a gene therapy vaccine, anti-angiogenesis agent and/or anti-neoplastic composition. Nonlimiting examples of chemotherapeutic agent, growth inhibitory agent, anti-cancer vaccine, anti-angiogenesis agent and anti-neoplastic composition that can be used in combination with the antibodies of the present invention are provided herein under "Definitions."

In some embodiments, an anti-inflammatory drug may be administered with the combination, such as a steroid or a non-steroidal anti-inflammatory drug (NSAID). In cases where it is desirable to render aberrantly proliferative cells quiescent in conjunction with or prior to treatment with anti-VISTA antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyl-testosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX®, can also be administered to the patient. When employing the methods or compositions described herein, other agents used in the modulation of tumor growth or metastasis in a clinical setting, such as antimimetics, can also be administered as desired.

Antibodies described herein can also be combined with an immunogenic agent, such as cancerous cells, purified tumor antigens (including recombinant proteins, peptides, and carbohydrate molecules), cells, and cells transfected with genes encoding immune stimulating cytokines (He et al., (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below).

In humans, some tumors have been shown to be immunogenic such as melanomas. By lowering the threshold of T cell activation via VISTA inhibition, the tumor responses in the host can be activated, allowing treatment of non-immunogenic tumors or those having limited immunogenicity.

An anti-VISTA antibody described herein, can also be combined with a vaccination protocol. Many experimental strategies for vaccination against tumors have been devised (see Rosenberg, S., 2000, Development of Cancer Vaccines, ASCO Educational Book Spring: 60-62; Logothetis, C, 2000, ASCO Educational Book Spring: 300-302; Khayat, D. 2000, ASCO Educational Book Spring: 414-428; Foon, K. 2000, ASCO Educational Book Spring: 730-738; see also Restifo, N. and Sznol, M., Cancer Vaccines, Ch. 61, pp. 3023-3043 in DeVita et al. (eds.), 1997, Cancer: Principles and Practice of Oncology, Fifth Edition). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci U.S.A.* 90: 3539-43).

The study of gene expression and large scale gene expression patterns in various tumors has led to the definition of so called tumor specific antigens (Rosenberg, S A (1999) *Immunity* 10:281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. VISTA inhibition can be used in conjunction with a collection of recombinant proteins and/or peptides expressed in a tumor in order to generate an immune response to these proteins. These proteins are normally viewed by the immune system as self antigens and are therefore tolerant to them. The tumor antigen can include the protein telomerase, which is required for the synthesis of telomeres of chromosomes and which is expressed in more than 85% of human cancers and in only a limited number of somatic tissues (Kim et al. (1994) Science 266:2011-2013). Tumor antigen can also be "neo-antigens" expressed in cancer cells because of somatic mutations that alter protein sequence or create fusion proteins between two unrelated sequences (i.e., bcr-abl in the Philadelphia chromosome), or idiotype from B cell tumors.

Other tumor vaccines can include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which can be used in conjunction with VISTA inhibition is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot & Srivastava (1995) *Science* 269:1585-1588; Tamura et al. (1997) *Science* 278:117-120).

Oncolytic viruses may also be used in combination with VISTA antibodies.

Dendritic cells (DC) are potent antigen presenting cells that can be used to prime antigen-specific responses. DCs can be produced ex vivo and loaded with various protein and peptide antigens as well as tumor cell extracts (Nestle et al. (1998) *Nature Medicine* 4:328-332). DCs can also be transduced by genetic means to express these tumor antigens as well. DCs have also been fused directly to tumor cells for the purposes of immunization (Kugler et al. (2000) *Nature Medicine* 6:332-336). As a method of vaccination, DC immunization can be effectively combined with VISTA inhibition to activate more potent anti-tumor responses.

Infectious Disease Treatments

Methods described herein can also be used to treat patients that have been exposed to particular toxins or pathogens. Accordingly, this disclosure also contemplates methods of treating an infectious disease in a subject comprising administering to the subject an antibody as described herein, e.g., an antagonist VISTA antibody, such that the subject is treated for the infectious disease. Similar to its application to tumors as discussed above, antibody-mediated VISTA inhibition can be used alone, or as an adjuvant, in combination with vaccines, to stimulate the immune response to pathogens, toxins, and self-antigens. Examples of pathogens for which this therapeutic approach might be particularly useful, include pathogens for which there is currently no effective vaccine, or pathogens for which conventional vaccines are less than completely effective. These include, but are not limited to HIV, Hepatitis (A, B, & C), Influenza, Herpes, Giardia, Malaria, *Leishmania, Staphylococcus aureus, Pseudomonas aeruginosa*. VISTA inhibition can be useful against established infections by agents such as HIV that present altered antigens over the course of the infections.

Some examples of pathogenic viruses causing infections that may be treatable by methods described herein include HIV, hepatitis (A, B, or C), herpes virus (e.g., VZV, HSV-1, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus and arboviral encephalitis virus.

Some examples of pathogenic bacteria causing infections that may be treatable by methods described herein include chlamydia, rickettsial bacteria, mycobacteria, staphylococci, streptococci, pneumonococci, meningococci and gonococci, klebsiella, proteus, serratia, pseudomonas, legionella, diphtheria, salmonella, bacilli, cholera, tetanus, botulism, anthrax, plague, leptospirosis, and Lymes disease bacteria.

Some examples of pathogenic fungi causing infections that may be treatable by methods described herein include *Candida* (*albicans, krusei, glabrata, tropicalis*, etc.), *Cryptococcus neoformans, Aspergillus* (*fumigatus, niger*, etc.), Genus *Mucorales* (*mucor, absidia, rhizopus*), *Sporothrix schenkii, Blastomyces dermatitidis, Paracoccidioides brasiliensis, Coccidioides immitis* and *Histoplasma capsulatum.*

Some examples of pathogenic parasites causing infections that may be treatable by methods described herein include *Entamoeba histolytica, Balantidium coli*, Naegleriafowleri, *Acanthamoeba* sp., *Giardia lambia, Cryptosporidium* sp., *Pneumocystis carinii, Plasmodium vivax, Babesia microti, Trypanosoma brucei, Trypanosoma cruzi, Leishmania donovani, Toxoplasma gondii*, and *Nippostrongylus brasiliensis.*

In all of the above methods, VISTA inhibition can be combined with other forms of immunotherapy, e.g., those described herein, such as cytokine treatment (e.g., interferons, GM-CSF, G-CSF, IL-2), or bispecific antibody therapy, which may provide for enhanced presentation of tumor antigens (see, e.g., Holliger (1993) *Proc. Natl. Acad. Sci. USA* 90:6444-6448; Poljak (1994) Structure 2:1121-1123).

Routes of Administration and Carriers

In various embodiments, antibodies may be administered in vivo by various routes, including, but not limited to, oral, intra-arterial, parenteral, intranasal, intramuscular, intracardiac, intraventricular, intratracheal, buccal, rectal, intraperitoneal, intradermal, topical, transdermal, and intrathecal, or otherwise by implantation or inhalation. The subject compositions may be formulated into preparations in solid, semi-solid, liquid, or gaseous forms; including, but not limited to, tablets, capsules, powders, granules, ointments, solutions, suppositories, enemas, injections, inhalants, and aerosols. A nucleic acid molecule encoding an antibody may be coated onto gold microparticles and delivered intradermally by a particle bombardment device, or "gene gun," as described in the literature (see, e.g., Tang et al., *Nature* 356:152-154 (1992)). The appropriate formulation and route of administration may be selected according to the intended application.

In various embodiments, compositions comprising antibodies are provided in formulations with a wide variety of pharmaceutically acceptable carriers (see, e.g., Gennaro, *Remington: The Science and Practice of Pharmacy with Facts and Comparisons: Drugfacts Plus,* $20^{th}$ ed. (2003); Ansel et al., *Pharmaceutical Dosage Forms and Drug Delivery Systems,* $7^{th}$ ed., Lippencott Williams and Wilkins (2004); Kibbe et al., *Handbook of Pharmaceutical Excipients,* $3^{rd}$ ed., Pharmaceutical Press (2000)). Various pharmaceutically acceptable carriers, which include vehicles, adjuvants, and diluents, are available. Moreover, various pharmaceutically acceptable auxiliary substances, such as pH adjusting and buffering agents, tonicity adjusting agents, stabilizers, wetting agents and the like, are also available. Non-limiting exemplary carriers include saline, buffered saline, dextrose, water, glycerol, ethanol, and combinations thereof.

In various embodiments, compositions comprising antibodies may be formulated for injection, including subcutaneous administration, by dissolving, suspending, or emulsifying them in an aqueous or nonaqueous solvent, such as vegetable or other oils, synthetic aliphatic acid glycerides, esters of higher aliphatic acids, or propylene glycol; and if desired, with conventional additives such as solubilizers, isotonic agents, suspending agents, emulsifying agents, stabilizers and preservatives. In various embodiments, the compositions may be formulated for inhalation, for example, using pressurized acceptable propellants such as dichlorodifluoromethane, propane, nitrogen, and the like. The compositions may also be formulated, in various embodiments, into sustained release microcapsules, such as with biodegradable or non-biodegradable polymers. A non-limiting exemplary biodegradable formulation includes poly lactic acid-glycolic acid polymer. A non-limiting exemplary non-biodegradable formulation includes a polyglycerin fatty acid ester. Certain methods of making such formulations are described, for example, in EP 1 125 584 A1.

Pharmaceutical packs and kits comprising one or more containers, each containing one or more doses of an antibody or combination of antibodiesare also provided. In some embodiments, a unit dosage is provided wherein the unit dosage contains a predetermined amount of a composition comprising an antibody or combination of antibodies, with or without one or more additional agents. In some embodiments, such a unit dosage is supplied in single-use prefilled syringe for injection. In various embodiments, the composition contained in the unit dosage may comprise saline, sucrose, or the like; a buffer, such as phosphate, or the like; and/or be formulated within a stable and effective Ph range. Alternatively, in some embodiments, the composition may be provided as a lyophilized powder that may be reconstituted upon addition of an appropriate liquid, for example, sterile water. In some embodiments, the composition comprises one or more substances that inhibit protein aggregation, including, but not limited to, sucrose and arginine. In some embodiments, a composition of the invention comprises heparin and/or a proteoglycan.

Pharmaceutical compositions are administered in an amount effective for treatment or prophylaxis of the specific indication. The therapeutically effective amount is typically dependent on the weight of the subject being treated, his or her physical or health condition, the extensiveness of the condition to be treated, or the age of the subject being treated. In general, antibodies may be administered in an amount in the range of about 10 μg/kg body weight to about 100 mg/kg body weight per dose. In some embodiments, antibodies may be administered in an amount in the range of about 50 μg/kg body weight to about 5 mg/kg body weight per dose. In some embodiments, antibodies may be administered in an amount in the range of about 100 μg/kg body weight to about 10 mg/kg body weight per dose. In some embodiments, antibodies may be administered in an amount in the range of about 100 μg/kg body weight to about 20 mg/kg body weight per dose. In some embodiments, antibodies may be administered in an amount in the range of about 0.5 mg/kg body weight to about 20 mg/kg body weight per dose.

The antibody compositions may be administered as needed to subjects. Determination of the frequency of administration may be made by persons skilled in the art, such as an attending physician based on considerations of the condition being treated, age of the subject being treated, severity of the condition being treated, general state of health of the subject being treated and the like. In some embodiments, an effective dose of an antibody is administered to a subject one or more times. In various embodiments, an effective dose of an antibody is administered to the subject once a month, less than once a month, such as, for example, every two months or every three months. In other embodiments, an effective dose of an antibody is administered more than once a month, such as, for example, every three weeks, every two weeks or every week. In some embodiments, an effective dose of an antibody is administered once per 1, 2, 3, 4, or 5 weeks. In some embodiments, an effective dose of an antibody is administered twice or three times per week. An effective dose of an antibody is administered to the subject at least once. In some embodiments, the effective dose of an antibody may be administered multiple times, including for periods of at least a month, at least six months, or at least a year.

In certain embodiments, the combination of the anti-VISTA antibody and a second agent discussed herein can be administered concurrently as a single composition in a pharmaceutically acceptable carrier, or concurrently as separate compositions with the anti-VISTA antibody and the second agent in a pharmaceutically acceptable carrier. In one embodiment, the combination of the anti-VISTA antibody and the second agent can be administered sequentially. The administration of the two agents can start at times that are, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks apart, or administration of the second agent can start, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks after the first agent has been administered.

Methods of Identifying Low pH Binding h VISTA-ECD Abs

Also provided herein are methods for identifying Abs that specifically bind to a VISTA-ECD protein in acidic (or low pH) conditions. In certain embodiments, a method for identifying an Ab that binds specifically to a VISTA-ECD protein at pH 6.5 or less comprises contacting a test Ab or plurality of test Abs with a VISTA-ECD protein at pH 6.5 or less, and selecting the test Ab if it binds to the ECD of the VISTA protein with a $K_D$ of $10^{-7}$ M, $10^{-8}$ M, $10^{-9}$ M or less. In some embodiments, the method is performed at pH 6.5, while in others it is performed at pH 6.0, or at pH 5.5, or at pH 5.0. In some embodiments, the VISTA-ECD protein is a hVISTA-ECD protein, or comprises the hVISTA IgV domain, or is a polypeptide comprising amino acids 20-95 of SEQ ID NO:2, or amino acids 20-70, 35-95, or 35-70 of SEQ ID NO:2. In some embodiments, the polypeptide also comprises amino acids 95-105 of SEQ ID NO:2. In some embodiments, the polypeptide comprises amino acids 35-127 or 37-125 of SEQ ID NO: 2.

In some embodiments, the method further comprises testing binding of the test Ab or plurality of test Abs at neutral, physiological or alkaline pH, such as at pH 7.0 or pH 7.4. In some embodiments, the method further comprises selecting an antibody if it not only binds to the VISTA-ECD protein with a $K_D$ of $10^{-7}$ M, $10^{-8}$ M, $10^{-9}$ M or less at pH 6.5 or lower, but also if it binds specifically to the polypeptide at pH 7.0 or pH 7.4. In some embodiments, test Abs are selected if they specifically bind to the VISTA-ECD protein in acidic conditions, e.g., at pH 6.5 or less, also specifically bind the VISTA-ECD protein at neutral and/or alkaline pH with similar affinity (i.e. they are "pan binders"). For example, some such Abs may bind to the VISTA-ECD protein with a $K_D$ of $10^{-7}$ M, $10^{-8}$ M, $10^{-9}$ M or less at both pH 6.5 and at pH 7.0 or pH 7.4 (at a constant temperature, e.g., of 25° C. or at 37° C.) such that the $K_D$ at pH 6.5 is within 1.5-fold of the $K_D$ at pH 7.0.

Certain Abs may be selected if they specifically bind to the VISTA-ECD protein in acidic conditions, e.g., at pH 6.5 or less with higher affinity than at neutral or alkaline pH ("pH sensitive binders" or "pH sensitive Abs"). For example, in some embodiments, Abs may bind to the VISTA-ECD protein with a $K_D$ of $10^{-8}$ M or less at pH 6.5 and with a $K_D$ of more than $10^{-8}$M at pH 7.0 or pH 7.4. In some such embodiments, Abs may bind to the VISTA-ECD protein with a $K_D$ of $10^{-8}$ M or less at pH 6.5 and with a $K_D$ at pH 7.0 or pH 7.4 that is more than 1.5-fold higher than that at pH 6.5 In certain embodiments, a pH sensitive Ab is selected if it specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 or pH 7.4 (at a constant temperature, e.g., of 25° C. or at 37° C.). For example, in some cases an Ab is selected if it binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 or pH 7.4 or higher (at a constant temperature, e.g., of 25° C. or at 37° C.).

In certain embodiments, an Ab is selected if it specifically binds to the VISTA-ECD protein with a $k_{off}$ that is lower in acidic conditions relative to that in neutral, physiological or alkaline conditions. In certain embodiments, an Ab is selected if it binds to the VISTA-ECD protein in acidic conditions with a $k_{off}$ that is at least 1.5 fold, 2 fold, 5 fold, 10 fold, 20 fold, 50 fold or 100 fold lower at pH 6.5 than the $k_{off}$ at pH 7.0 or pH 7.4, as measured, e.g., at 25° C. or at 37° C. For example, in some embodiments, an Ab is selected if it binds to the VISTA-ECD protein with a $k_{off}$ rate that is at least 1.5 fold, 2 fold, 5 fold, 10 fold, 20 fold, 50 fold or 100 fold lower at pH 6.0, relative to pH 7.0 or pH 7.4, as measured, e.g., at 25° C. or at 37° C.

In certain embodiments, an Ab is selected if it binds to the VISTA-ECD protein with a $k_{on}$ that is higher in acidic conditions relative to neutral or alkaline conditions. In certain embodiments, an Ab is selected if it binds to the VISTA-ECD protein in acidic conditions with a $k_{on}$ that is at least 2 fold, 5 fold, 10 fold, 20 fold, 50 fold or 100 fold higher at pH 6.5 than the $k_{on}$ at pH 7.0 or pH 7.4, as measured, e.g., at 25° C. or at 37° C. For example, in some embodiments, an Ab is selected if it binds to the VISTA-ECD protein with a $k_{on}$ that is at least 2 fold, 5 fold, 10 fold, 20 fold, 50 fold or 100 fold higher at pH 6.0 than at pH 7.0 or pH 7.4, as measured, e.g., at 25° C. or at 37° C.

Methods of Modifying the pH Sensitivity of VISTA-ECD Binding Abs

An Ab that binds to a VISTA-ECD protein, but does not do so at pH 6.5 or less, or does not do so with a high affinity at pH 6.5 or less, can be engineered to increase its affinity of binding at pH 6.5 or lower. For example, the paratope of an Ab may be mutated, e.g., by the substitution of one or more amino acid residues. For example, in some embodiments, 1 to 8, e.g., 1 to 6, 1 to 4, 1 to 3, 1 to 2, or 1 amino acid residues in the heavy or light chain of the Ab that are contact residues with VISTA-ECD (e.g. residues in one or more of the CDRs) may be replaced with a different amino acid residue. Then, the mutated Ab may be tested for binding to the VISTA-ECD protein at pH 6.5 or less and Ab species binding with higher affinity than the parent antibody may be selected. If desired, the steps above may be repeated so that two or more rounds of mutagenesis and selection are performed on the Abs and the highest affinity binders at the acidic pH are selected. In some embodiments, such selections may improve the anti-tumor efficacy of the resulting antibody over its parent.

The above selection method may also be designed to follow the previously described general selection for VISTA-ECD protein specifically binding antibodies. Namely, in certain embodiments, the improved Ab is selected if it binds to the ECD of the VISTA protein with a $K_D$ of $10^{-8}$ M or less at pH 6.5. In some embodiments, the selection is performed at pH 6.0, or at pH 5.5, or at pH 5.0 instead of at pH 6.5. In some embodiments, the VISTA-ECD protein used for the selection process is a complete hVISTA-ECD protein, or is a polypeptide that comprises the hVISTA IgV domain, or is a polypeptide comprising amino acids 20-95 of SEQ ID NO:2, or amino acids 20-70, 35-95, or 35-70 of SEQ ID NO:2. In some embodiments, the polypeptide also comprises amino acids 95-105 of SEQ ID NO:2. In some embodiment a polypeptide comprising amino acid residues 35-127 of SEQ ID NO: 2 is used.

In some embodiments, a method for improving the binding of a VISTA antibody to VISTA ECD at acidic pH comprises increasing the number of glutamic acid, aspartic acid and/or histidine residues in one or more VH or VL CDRs, e.g., VH CDR1, CDR2 and CDR3 or only VH CDR1 and CDR3. In certain embodiments, a method comprises increasing the number of glutamic acid, aspartic acid and/or histidine residues in areas of the antibody that contacts hVISTA as determined, e.g., by crystallography.

In some embodiments, the method further comprises testing binding of the selected Ab at neutral, alkaline or physiological pH, such as at pH 7.0 or 7.4. In some embodiments, the method further comprises selecting an antibody if it not only binds to the VISTA-ECD protein with a $K_D$ of $10^{-8}$ M or less at pH 6.5 or lower, but also if it binds specifically to the polypeptide at pH 7.0 or 7.4. In some such embodiments, Abs are selected if they specifically bind to the VISTA-ECD protein in acidic conditions, e.g., at pH 6.5 or less, and also specifically bind the VISTA-ECD protein at neutral and/or alkaline or physiological pH with at similar affinity (i.e. they are "pan binders"). For example, some such Abs may bind to the VISTA-ECD protein with a $K_D$ of $10^{-8}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0 or at pH 7.4.

Certain Abs may be selected if they specifically bind to the VISTA-ECD protein in acidic conditions, e.g., at pH 6.5 or less with higher affinity than at neutral, physiological, or alkaline pH ("pH sensitive binders" or "pH sensitive Abs"). For example, in some embodiments, Abs may bind to the VISTA-ECD protein with a $K_D$ of $10^{-8}$ M or less at pH 6.5 and with a $K_D$ of more than $10^{-8}$M at pH 7.0. In some such embodiments, Abs may bind to the VISTA-ECD protein with a $K_D$ of $10^{-8}$ M or less at pH 6.5 and with a $K_D$ at pH 7.0 that is more than 1.5-fold higher than that at pH 6.5. In certain embodiments, a pH sensitive Ab is selected if it specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 or pH 7.4 (at a constant temperature, e.g., of 25° C. or at 37° C.). For example, in some cases an Ab is selected if it binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 or pH 7.4 or higher (at a constant temperature, e.g., of 25° C. or at 37° C.).

In certain embodiments, the method further comprises determining $k_{off}$ at two pH values. In some such embodiments, an Ab is selected if it specifically binds to the VISTA-ECD protein with a $k_{off}$ that is lower in acidic conditions relative to that in neutral, physiological, or alkaline conditions. In certain embodiments, an Ab is selected if it binds to the VISTA-ECD protein in acidic conditions with a $k_{off}$ that is at least 1.5 fold, 2 fold, 5 fold, 10 fold, 20 fold, 50 fold or 100 fold lower at pH 6.5 than the $k_{off}$ at pH 7.0 or pH 7.4, as measured, e.g., at 25° C. or at 37° C. For example, in some embodiments, an Ab is selected if it binds to the VISTA-ECD protein with a $k_{off}$ rate that is at least 1.5 fold, 2 fold, 5 fold, 10 fold, 20 fold, 50 fold or 100 fold lower at pH 6.0, relative to pH 7.0, as measured, e.g., at 25° C. or at 37° C.

In certain embodiments, the method further comprises determining $k_{on}$ at two pH values. In some such embodiments, an Ab is selected if it binds to the VISTA-ECD protein with a $k_{on}$ that is higher in acidic conditions relative to neutral, physiological, or alkaline conditions. In certain embodiments, an Ab is selected if it binds to the VISTA-ECD protein in acidic conditions with a $k_{on}$ that is at least 2 fold, 5 fold, 10 fold, 20 fold, 50 fold or 100 fold higher at pH 6.5 than the $k_{on}$ at pH 7.0 or pH 7.4, as measured, e.g., at 25° C. or at 37° C. For example, in some embodiments, an Ab is selected if it binds to the VISTA-ECD protein with a $k_{on}$ that is at least 2 fold, 5 fold, 10 fold, 20 fold, 50 fold or 100 fold higher at pH 6.0 than at pH 7.0 or pH 7.4, as measured, e.g., at 25° C. or at 37° C.

Antibodies that bind preferentially to huVISTA at acidic pH, versus neutral or physiological pH can be identified by positively screening a library of VISTA antibodies or Fabs or scFvs for binding at acidic pH, e.g., pH 6.0 or 6.5, and negatively screening the library for the lack of binding at neutral pH, e.g., pH 7.0 or physiological pH, e.g., pH 7.4. A library may be enriched in glutamic acid, aspartic acid and histidine residues, such as to select binding domains that may be charged and more likely to bind to VISTA at acidic pH. The screening may involve positive selection at acidic pH and negative selections at neutral or physiological pH. The positive and negative selections may be alternated.

Alternatively, an antibody binding to VISTA at neutral and acidic pH can be engineered to lack binding at neutral pH and maintaining or even enhancing binding at acidic pH. For example, a library may be created by substituting VH and optionally VL amino acid residues, such as in one or more CDRs and screening the library by positive selection for antibodies that bind to hVISTA at acidic pH and negative selection for antibodies that do not bind to VISTA at neutral (or physiological) pH. A similar method may be used to engineer VISTA binding antibodies having the desired pH selective, pH dependent or pH independent VISTA binding profile.

SPECIFIC EXEMPLARY EMBODIMENTS

Additional embodiments of this disclosure include the following:

1. An isolated antibody that binds specifically to human VISTA (hVISTA) in acidic conditions.
2. The isolated antibody of embodiment 1, which binds specifically to hVISTA in acidic conditions, but not significantly in neutral or physiological conditions.
3. The isolated antibody of embodiment 1 or 2, wherein the antibody binds to hVISTA in acidic conditions with a $K_D$ that is at least 10 fold lower than its $K_D$ in neutral or physiological conditions.
4. The isolated antibody of any one of embodiments 1 to 3, wherein the antibody binds to hVISTA in acidic conditions with a $K_D$ that is at least 100 fold lower than its $K_D$ in neutral or physiological conditions.
5. The isolated antibody of any one of embodiments 1-4, wherein the antibody binds to hVISTA in acidic conditions with a $K_D$ that is at least 1000 fold lower than its $K_D$ in neutral or physiological conditions.
6. The isolated antibody of any one of embodiments 1-5, wherein the antibody binds to hVISTA in neutral or physiological conditions with a $K_D$ of $10^{-5}$ M or more.
7. The isolated antibody of any one of embodiments 1-6, wherein the antibody binds to hVISTA in neutral or physiological conditions with a $K_D$ of $10^{-4}$ M or more.
8. The isolated antibody of any one of embodiments 1-7, wherein the antibody binds to hVISTA in neutral or physiological conditions with a $K_D$ of $10^{-3}$ M or more.
9. The isolated antibody of any one of embodiments 1-8, wherein the antibody binds to hVISTA in acidic conditions with a $K_D$ of $10^{-7}$ M or less.
10. The isolated antibody of any one of embodiments 1-9, wherein the antibody binds to hVISTA in acidic conditions with a $K_D$ of $10^{-8}$ M or less.
11. The isolated antibody of any one of embodiments 1-10, wherein the antibody binds to hVISTA in acidic conditions with a $K_D$ of $10^{-9}$ M or less.
12. The isolated antibody of any one of embodiments 1-11, wherein the antibody binds to hVISTA in acidic conditions with a $K_D$ of $10^{-7}$ or less and binds to hVISTA in neutral or physiological conditions with a $K_D$ of $10^{-4}$ or more.
13. The isolated antibody of any one of embodiments 1-12, wherein the antibody binds to hVISTA in acidic conditions with a $K_D$ of $10^{-7}$ or less and binds to hVISTA in neutral or physiological conditions with a $K_D$ of $10^{-5}$ or more.
14. The isolated antibody of any one of embodiments 1-13, wherein the antibody binds to hVISTA in acidic conditions with a $k_{off}$ that is at least 5 fold lower than its $k_{off}$ in neutral or physiological conditions.
15. The isolated antibody of any one of embodiments 1-14, wherein the antibody binds to hVISTA in acidic conditions with a $k_{off}$ that is at least 10 fold lower than its $k_{off}$ in neutral or physiological conditions.
16. The isolated antibody of any one of embodiments 1-15, wherein the antibody binds to hVISTA in acidic conditions with a $k_{off}$ that is at least 50 fold lower than its $k_{off}$ in neutral or physiological conditions.
17. The isolated antibody of any one of embodiments 1-16, wherein the antibody binds to hVISTA in acidic conditions with a $k_{off}$ that is at least 100 fold lower than its $k_{off}$ in neutral or physiological conditions.
18. The isolated antibody of any one of embodiments 1-17, wherein the antibody binds to hVISTA in acidic conditions with a $k_{off}$ of $7\times10^{-3}$ $s^{-1}$ or less.
19. The isolated antibody of any one of embodiments 1-18, wherein the antibody binds to hVISTA in acidic conditions with a $k_{off}$ of $5\times10^{-3}$ $s^{-1}$ or less.
20. The isolated antibody of any one of embodiments 1-19 wherein the antibody binds to hVISTA in acidic conditions with a $k_{off}$ of $3\times10^{-3}$ $s^{-1}$ or less.
21. The isolated antibody of any one of embodiments 1-20, wherein the antibody binds to hVISTA in acidic conditions with a $k_{off}$ of $10^{-3}$ $s^{-1}$ or less.
22. The isolated antibody of any one of embodiments 1-21, wherein the antibody binds to hVISTA in acidic conditions with a $k_{off}$ of $7\times10^{-4}$ $s^{-1}$ or less.
23. The isolated antibody of any one of embodiments 1-22, wherein the antibody binds to hVISTA in acidic conditions with a $k_{off}$ of $5\times10^{-4}$ $s^{-1}$ or less.
24. The isolated antibody of any one of embodiments 1-23, wherein the antibody binds to hVISTA in acidic conditions with a $k_{off}$ of $3\times10^{-4}$ $s^{-1}$ or less.
25. The isolated antibody of any one of embodiments 1-24, wherein the antibody binds to hVISTA in acidic conditions with a $k_{off}$ of $10^{-4}$ $s^{-1}$ or less.
26. The isolated antibody of any one of embodiments 1-25, wherein the antibody binds to hVISTA in acidic conditions with a $k_{off}$ of $7\times10^{-5}$ $s^{-1}$ or less.
27. The isolated antibody of any one of embodiments 1-26, wherein the antibody binds to hVISTA in acidic conditions with a $k_{off}$ of $5\times10^{-5}$ $s^{-1}$ or less.
28. The isolated antibody of any one of embodiments 1-21, wherein the antibody binds to hVISTA in acidic conditions with a $k_{off}$ of $3\times10^{-5}$ $s^{-1}$ or less.
29. The isolated antibody of any one of embodiments 1-28, wherein the antibody binds to hVISTA in acidic conditions with a $k_{off}$ of $10^{-5}$ $s^{-1}$ or less.
30. The isolated antibody of any one of embodiments 1-29, wherein the antibody binds to hVISTA in neutral or physiological conditions with a $k_{off}$ of $10^{-3}$ $s^{-1}$ or more.
31. The isolated antibody of any one of embodiments 1-30, wherein the antibody binds to hVISTA in neutral or physiological conditions with a $k_{off}$ of $3\times10^{-3}$ $s^{-1}$ or more.
32. The isolated antibody of any one of embodiments 1-31, wherein the antibody binds to hVISTA in neutral or physiological conditions with a $k_{off}$ of $5\times10^{-3}$ $s^{-1}$ or more.

33. The isolated antibody of any one of embodiments 1-32, wherein the antibody binds to hVISTA in neutral or physiological conditions with a $k_{off}$ of $7\times10^{-3}$ $s^{-1}$ or more.
34. The isolated antibody of any one of embodiments 1-33, wherein the antibody binds to hVISTA in neutral or physiological conditions with a $k_{off}$ of $10^{-2}$ $s^{-1}$ or more.
35. The isolated antibody of any one of embodiments 1-34, wherein the antibody binds to hVISTA in neutral or physiological conditions with a $k_{off}$ of $3\times10^{-2}$ $s^{-1}$ or more.
36. The isolated antibody of any one of embodiments 1-35, wherein the antibody binds to hVISTA in neutral or physiological conditions with a $k_{off}$ of $5\times10^{-2}$ $s^{-1}$ or more.
37. The isolated antibody of any one of embodiments 1-36, wherein the antibody binds to hVISTA in neutral or physiological conditions with a $k_{off}$ of $7\times10^{-2}$ $s^{-1}$ or more.
38. The isolated antibody of any one of embodiments 1-37, wherein binding of the antibody to hVISTA in neutral or physiological conditions is not detectable, e.g., via surface plasmon resonance (SPR).
39. The isolated antibody of any one of embodiments 1-38, wherein the antibody binds to hVISTA in acidic conditions with a $k_{off}$ of $5\times10^{-3}$ $s^{-1}$ or less and in neutral or physiological conditions with a $k_{off}$ of $7\times10^{-3}$ $s^{-1}$ or more.
40. The isolated antibody of any one of embodiments 1-39, wherein the antibody binds to hVISTA in acidic conditions with a $k_{off}$ of $10^{-4}$ $s^{-1}$ or less and in neutral or physiological conditions with a $k_{off}$ of $10^{-2}$ $s^{-1}$ or more.
41. The isolated antibody of any one of embodiments 1-40, wherein the antibody binds to hVISTA in acidic conditions with a $K_D$ of $10^{-8}$ M or less and a $k_{off}$ of $5\times10^{-3}$ $s^{-1}$ or less and in neutral of physiological conditions with a $K_D$ of $10^{-6}$ M or more and a $k_{off}$ of $7\times10^{-3}$ $s^{-1}$ or more.
42. The isolated antibody of any one of embodiments 1-41, wherein the antibody binds to hVISTA in acidic conditions with a $K_D$ of $10^{-8}$ M or less and a $k_{off}$ of $3\times10^{-3}$ $s^{-1}$ or less and in neutral of physiological conditions with a $K_D$ of $10^{-6}$ M or more and a $k_{off}$ of $10^{-2}$ $s^{-1}$ or more.
43. The isolated antibody of any one of embodiments 1-42, wherein the antibody binds to hVISTA in acidic conditions with a $K_D$ of $10^{-12}$ to $10^{-8}$ M and a $k_{off}$ of $10^{-4}$ to $5\times10^{-3}$ $s^{-1}$ and in neutral of physiological conditions with a $K_D$ of $10^{-7}$ to $10^{-4}$ M and a $k_{off}$ of $3\times10^{-3}$ to $10^{-2}$ $s^{-1}$ or more.
44. The isolated antibody of any one of embodiments 1-43, wherein the antibody binds to hVISTA in acidic conditions with a $K_D$ of $10^{-12}$ to $10^{-8}$ M and a $k_{off}$ of $10^{-4}$ to $5\times10^{-3}$ $s^{-1}$ and in neutral of physiological conditions with a $K_D$ of $10^{-7}$ to $10^{-4}$ M and a $k_{off}$ of $3\times10^{-3}$ to $10^{-2}$ $s^{-1}$ or more; and wherein the antibody binds to cyno VISTA with a $K_D$ of $10^{-7}$ or less.
45. The isolated antibody of any one of embodiments 1-44, wherein the antibody binds to hVISTA with a $K_D$ that is at least 10 fold lower at pH 6.9 than at pH 7.4 and/or a $K_D$ that is at least 100 fold lower at pH 6.5 than at pH 7.4 and at least 1000 fold lower at pH 6.0 than at pH 7.4.
46. The isolated antibody of any one of embodiments 1-45, wherein the antibody binds to cynomolgus (cyno) VISTA.
47. The isolated antibody of embodiment 46, wherein the antibody binds to cyno VISTA with higher affinity in acidic conditions relative to physiologic conditions.
48. The isolated antibody of any one of embodiments 45-47, wherein the antibody binds to cyno VISTA in acidic conditions with a $K_D$ of $10^{-8}$ or less and/or a $k_{off}$ of $10^{-2}$ or less and in physiologic conditions with a $K_D$ of $10^{-6}$ or more and/or a $k_{off}$ of $10^{-2}$ or more.
49. The isolated antibody of any one of embodiments 1-48, wherein acidic conditions are conditions having a pH of 6.5 or less.
50. The isolated antibody of any one of embodiments 1-49, wherein acidic conditions are conditions having a pH of 6.0 to 6.5.
51. The isolated antibody of any one of embodiment 1-50, wherein neutral conditions are conditions having a pH of 7.0.
52. The isolated antibody of any one of embodiments 1-51, wherein physiological conditions are conditions having a pH of 7.35 to 7.45.
53. The isolated antibody of any one of embodiments 1-52, wherein physiological conditions are conditions having a pH of 7.4.
54. The isolated antibody of any one of embodiments 1-53, wherein the antibody inhibits the binding of h VISTA to human T cells, such as human CD4+ T cells (an antagonist antibody).
55. The isolated antibody of embodiment 54, wherein the antibody inhibits the binding of hVISTA to human T cells in conditions having a pH of less than pH 7.0.
56. The isolated antibody of any one of embodiments 1-55, wherein the antibody inhibits the binding of hVISTA to human PSGL-1 (huPSGL-1) and/or competes with huPSGL1 for binding to hVISTA.
57. The isolated antibody of embodiment 56, wherein the antibody inhibits the binding of hVISTA to huPSGL-1 in conditions having a pH of less than pH 7.0.
58. The isolated antibody of anyone of embodiments 1-57, wherein the antibody inhibits the binding of hVISTA to heparan sulfate proteoglycans.
59. The isolated antibody of embodiment 58, wherein the antibody inhibits the binding of hVISTA to heparan sulfate proteoglycans in conditions having a pH of less than pH 7.0.
60. The isolated antibody of any one of embodiments 55, 57 or 59, wherein a condition having a pH of less than pH 7.0 is a tumor or any diseased area having a pH of less than pH 7.0 in a subject and in which an immune stimulation is desired.
61. The isolated antibody of any one of embodiments 1-60, wherein the antibody stimulates T cell activation, as evidenced by, e.g., enhancing T cell proliferation; enhancing IFN-γ production from T cells; and/or stimulating T cell receptor mediated NF-kB signaling.
62. The isolated antibody of embodiment 61, wherein the antibody stimulates T cell activation in conditions having a pH of less than pH 7.0.
63. The isolated antibody of any one of embodiments 1-62, wherein the antibody reduces VISTA mediated cell-cell adhesion.
64. The isolated antibody of any one of embodiments 1-53, wherein the antibody stimulates the activity of VISTA (an agonist antibody).

65. The isolated antibody of any one of embodiments 1-53 and 64, wherein the antibody stimulates the binding of h VISTA to human T cells, such as human CD4+ T cells.
66. The isolated antibody of embodiment 65, wherein the antibody stimulates the binding of hVISTA to human T cells in conditions having a pH of less than pH 7.0.
67. The isolated antibody of any one of embodiments 1-53 and 64-66, wherein the antibody stimulates the binding of h VISTA to huPSGL-1.
68. The isolated antibody of embodiment 67, wherein the antibody stimulates the binding of h VISTA to huPSGL-1 in conditions having a pH of less than pH 7.0.
69. The isolated antibody of any one of embodiments 1-53 and 64-68, wherein the antibody stimulates the binding of hVISTA to heparan sulfate proteoglycans.
70. The isolated antibody of embodiment 69, wherein the antibody stimulates the binding of hVISTA to heparan sulfate proteoglycans in conditions having a pH of less than pH 7.0.
71. The isolated antibody of any one of embodiments 66, 68 and 70, wherein a condition having a pH of less than pH 7.0 is an autoimmune (e.g., rheumatoid arthritis and lupus) milieu, an inflammation site, or any diseased area having a pH of less than pH 7.0 in a subject and in which an immune inhibition is desired.
72. The isolated antibody of any one of embodiments 1-71, wherein the antibody has a mean residence time (MRT) of at least 100, 200, 300, 400 or 500 days in Cynomolgus macaques.
73. The isolated antibody of any one of embodiments 1-72, wherein the antibody does not significantly bind to VISTA positive cells, e.g., neutrophils, in the peripheral blood of a subject to whom it is administered.
74. The isolated antibody of any one of embodiments 1-73, wherein the antibody does not significantly deplete VISTA positive cells, e.g., neutrophils, in peripheral blood of a subject to whom it is administered.
75. The isolated antibody of any one of embodiments 1-74, wherein the antibody has been engineered to bind to hVISTA at acidic pH, but not at neutral or physiological pH.
76. The isolated antibody of embodiment 75, wherein the antibody has been engineered by replacing from 1-8 amino acids in VH CDR1, CDR2 and/or CDR3 of a hVISTA binding antibody with a glutamic acid, aspartic acid or histidine residue.
77. The isolated antibody of any one of embodiments 1-63 and 72-76, wherein the antibody comprises VH CDR1, CDR2 and/or CDR3 of P1-061029 or a variant thereof comprising 1 to 6 or 1 to 8 amino acid differences in VH CDR1, CDR2 and/or CDR3 relative to antibody P1-061029, wherein at most 1, 2 or 3 amino acid variations are present in any one CDR; or alternatively, wherein the antibody comprises VH CDR1, CDR2 and/or CDR3 of P1-061015 or a variant thereof comprising 1 to 6 or 1 to 8 amino acid differences in VH CDR1, CDR2 and/or CDR3 relative to antibody P1-061015, wherein at most 1, 2 or 3 amino acid variations are present in any one CDR.
78. The isolated antibody of embodiment 77, wherein the antibody comprises VH CDR1, CDR2 and CDR3 of P1-061029 or a variant thereof comprising 1 to 6 or 1 to 8 amino acid differences in VH CDR1, CDR2 and/or CDR3 relative to P1-061029, or alternatively wherein the antibody comprises VH CDR1, CDR2 and CDR3 of P1-061015 or a variant thereof comprising 1 to 6 or 1 to 8 amino acid differences in VH CDR1, CDR2 and/or CDR3 relatively to P1-061015.
79. The isolated antibody of embodiment 77 or 78, wherein an amino acid variation is a substitution to a glutamic acid residue (E), aspartic acid residue (D) or a histidine residue (H).
80. The isolated antibody of any one of embodiments 77-79, wherein the antibody comprises a CDR1 comprising GFT$X_1X_2$D$X_3$AMH, wherein $X_1$ is D or L, $X_2$ is E or D and $X_3$ is E or Y (SEQ ID NO: 563);

a CDR2 comprising GI$X_4$W$X_5$S$X_6X_7$IGYADSVKG, wherein $X_4$ is D or N, $X_5$ is D or N, $X_6$ is D, E, H or A and $X_7$ is D, E, H or N (SEQ ID NO: 564); and/or a CDR3 comprising VPGYS$X_8$GWIDA$X_9$D$X_{10}$, wherein $X_8$ is E, H or G, $X_9$ is E, D or F and $X_{10}$ is D, E or V (SEQ ID NO: 565).

81. The antibody of embodiment 80, wherein the antibody comprises a CDR1 comprising GFT$X_1X_2$D$X_3$AMH, wherein $X_1$ is D or L, $X_2$ is E or D and $X_3$ is E or Y (SEQ ID NO: 563);

a CDR2 comprising GI$X_4$W$X_5$S$X_6X_7$IGYADSVKG, wherein $X_4$ is D or N, $X_5$ is D or N, $X_6$ is D, E, H or A and $X_7$ is D, E, H or N (SEQ ID NO: 564); and a CDR3 comprising VPGYS$X_8$GWIDA$X_9$D$X_{10}$, wherein $X_8$ is E, H or G, $X_9$ is E, D or F and $X_{10}$ is D, E or V (SEQ ID NO: 565).

82. The isolated antibody of embodiment 80 or 81, wherein $X_3$ is E and $X_9$ is E.
83. The isolated antibody of any one of embodiments 80-82, wherein $X_2$ is E, $X_7$ is E, and/or $X_8$ is H.
84. The isolated antibody of embodiment 83, wherein two or more of the following three conditions are met: $X_2$ is E, $X_7$ is E, and/or $X_8$ is H.
85. The isolated antibody of embodiment 84, wherein $X_2$ is E, $X_7$ is E and $X_8$ is H.
86. The isolated antibody of any one of embodiments 80-85, wherein $X_6$ is E.
87. The isolated antibody of any one of embodiments 80-85, wherein $X_6$ is A.
88. The isolated antibody of any one of embodiments 80-86, wherein $X_1$ is L, $X_4$ is N, $X_5$ is N and/or $X_{10}$ is V.
89. The isolated antibody of embodiment 88, wherein two or more of the following four conditions are met: $X_1$ is L, $X_4$ is N, $X_5$ is N and/or $X_{10}$ is V.
90. The isolated antibody of embodiment 89, wherein three or more of the following four conditions are met: $X_1$ is L, $X_4$ is N, $X_5$ is N and/or $X_{10}$ is V.
91. The isolated antibody of embodiment 90, wherein $X_1$ is L, $X_4$ is N, $X_5$ is N and/or $X_{10}$ is V.
92. The isolated antibody of any one of embodiments 80-91, wherein $X_{10}$ is D.
93. The isolated antibody of any one of embodiments 80-92, wherein $X_9$ is E.
94. The isolated antibody of any one of embodiments 80-93, wherein $X_2$ is E, $X_4$ is D and/or $X_6$ is E.
95. The isolated antibody of embodiment 94, wherein two or more of the following conditions are met: $X_2$ is E, $X_4$ is D and/or $X_6$ is E.
96. The isolated antibody of embodiment 95, wherein $X_2$ is E, $X_4$ is D and $X_6$ is E.

97. The isolated antibody of any one of embodiments 80-96, wherein $X_1$ is L, $X_3$ is Y, $X_5$ is N, $X_7$ is N and/or $X_8$ is G.

98. The isolated antibody of embodiment 97, wherein two or more of the following conditions are met: $X_1$ is L, $X_3$ is Y, $X_5$ is N, $X_7$ is N and/or $X_8$ is G.

99. The isolated antibody of embodiment 98, wherein three or more of the following conditions are met: $X_1$ is L, $X_3$ is Y, $X_5$ is N, $X_7$ is N and/or $X_8$ is G.

100. The isolated antibody of embodiment 99, wherein four or more of the following conditions are met: $X_1$ is L, $X_3$ is Y, $X_5$ is N, $X_7$ is N and/or $X_8$ is G. 101. The isolated antibody of embodiment 100, wherein $X_1$ is L, $X_3$ is Y, $X_5$ is N, $X_7$ is N and $X_8$ is G.

102. The isolated antibody of any one of embodiments 77-101, wherein the antibody comprises VH CDR1, CDR2 and/or CDR3 of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075,P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, or P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, P1-068748_D57K_D100S, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

103. The isolated antibody of embodiment 102, wherein the antibody comprises VH CDR1, CDR2 and CDR3 of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744 E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

104. The isolated antibody of any one of embodiments 77-103, wherein the antibody comprises VL CDR1, CDR2 and CDR3 of the VL of P1-061029 or P1-061015.

105. The isolated antibody of any one of embodiments 1-63 and 72-104, wherein the antibody comprises a VH comprising an amino acid sequence that is at least 90%, 95%, 97%, 98% or 99% identical to that of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S; or comprises the VH of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, modified by 1, 2, 3, 4, or 5 amino acid substitutions, modified by 1, 2, 3, 4, or 5 conservative amino acid substitutions, or modified (in the case of P1-061029 or one of its progeny) by one or both of K16R and T84A substitutions.

106. The isolated antibody of any one of embodiments 1-63 and 72-105, wherein the antibody comprises a VH comprising the amino acid sequence of the VH of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, or P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S; or comprises the VH of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G,P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, modified (in the case of P1-061029 or its progeny) by one or both of K16R and T84A substitutions.

107. The isolated antibody of any one of embodiments 1-106, wherein the antibody comprises a VL comprising an amino acid sequence that is at least 90%, 95%, 97%, 98% or 99% identical to that of P1-061029.

108. The isolated antibody of embodiment 107, wherein the antibody comprises the VL of P1-061029.

109. The isolated antibody of any one of embodiments 1-63 and 72-76, wherein the antibody comprises VH CDR1, CDR2 and/or CDR3 of P1-061015 or a variant thereof comprising 1-6 or 1-8 amino acid differences in VH CDR1, CDR2 and/or CDR3 relative to P1-061015, wherein at most 1, 2 or 3 amino acid variations are present in any one CDR.

110. The isolated antibody of embodiment 109, wherein the antibody comprises VH CDR1, CDR2 and CDR3 of P1-061015 or a variant thereof comprising 1-6 amino acid differences in VH CDR1, CDR2 and/or CDR3 relative to the P1-061015, wherein at most 1, 2 or 3 amino acid variations are present in any one CDR.

111. The isolated antibody of embodiments 108 or 109, wherein an amino acid variation is a substitution to a glutamic acid residue (E), aspartic acid residue (D) or a histidine residue (H).

112 The isolated antibody of any one of embodiments 108-111, wherein the antibody comprises a CDR1 comprising GFTF$X_1X_2X_3$MH, wherein $X_1$ is E, D, H or S; $X_2$ is H or Y; and $X_3$ is D or A;

a CDR2 comprising $X_4X_5$W$X_6$DGS$X_7X_8X_9X_{10}$ADSVKG, wherein $X_4$ is E, H or I; $X_5$ is D or I; $X_6$ is D or Y; $X_7$ is D or N; $X_8$ is D, H or K; $X_9$ is D, H or Y; and $X_{10}$ is E or Y; and/or a CDR3 comprising D$X_{11}X_{12}$FY$X_{13}X_{14}$YYDF$X_{15}$, wherein $X_{11}$ is E or S; $X_{12}$ is E or G; $X_{13}$ is D, E or S; $X_{14}$ is D or S; and $X_{15}$ is D, E or Y.

113. The antibody of any one of embodiments 108-112, wherein the antibody comprises a CDR1 comprising GFTF$X_1X_2X_3$MH, wherein $X_1$ is E, D, H or S; $X_2$ is H or Y; and $X_3$ is D or A;

a CDR2 comprising $X_4X_5$W$X_6$DGS$X_7X_8X_9X_{10}$ADSVKG, wherein $X_4$ is E, H or I; $X_5$ is D or I; $X_6$ is D or Y; $X_7$ is D or N; $X_8$ is D, H or K; $X_9$ is D, H or Y; and $X_{10}$ is E or Y; and a CDR3 comprising D$X_{11}X_{12}$FY$X_{13}X_{14}$YYDF$X_{15}$, wherein $X_{11}$ is E or S; $X_{12}$ is E or G; $X_{13}$ is D, E or S; $X_{14}$ is D or S; and $X_{15}$ is D, E or Y.

114. The isolated antibody of any one of embodiments 98-102, wherein the antibody comprises VH CDR1, CDR2 and/or CDR3 of P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

115. The isolated antibody of embodiment 114, wherein the antibody comprises VH CDR1, CDR2 and CDR3 of P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S.

116. The isolated antibody of any one of embodiments 98-115, wherein the antibody comprises VL CDR1, CDR2 and CDR3 of the VL of P1-061015.

117. The isolated antibody of any one of embodiments 98-116, wherein the antibody comprises a VH comprising an amino acid sequence that is at least 90%, 95%, 97%, 98% or 99% identical to that of P1-061015, P1-068736, P1-068738, P1-068740, P1-068742, P1-068744, P1-068748, P1-068750, P1-068752 or P1-068754; or comprising an amino acid sequence of the VH of P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, modified by 1, 2, 3, 4, or 5 amino acid substitutions, or modified by 1, 2, 3, 4, or 5 conservative amino acid substitutions.

118 The isolated antibody of any one of embodiments 98-117, wherein the antibody comprises a VH comprising the amino acid sequence of the VH of P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S; or comprising the amino acid sequence of the VH of P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, modified by 1, 2, 3, 4, or 5 amino acid substitutions, or modified by 1, 2, 3, 4, or 5 conservative amino acid substitutions.

119. The isolated antibody of any one of embodiments 98-118, wherein the antibody comprises a VL comprising an amino acid sequence that is at least 90%, 95%, 97%, 98% or 99% identical to that of P1-061015.

120. The isolated antibody of embodiment 119, wherein the antibody comprises a VL comprising the amino acid sequence of P1-061015, optionally modified by a T85V substitution.

121. The isolated isolated antibody of any one of embodiments 1-120, wherein the antibody binds at or near the histidine rich region of hVISTA, such as the histidine-rich β-sheet extension.

122. The isolated isolated antibody of embodiment 121, wherein the antibody binds at or near the histidine rich region of hVISTA, such as the histidine-rich β-sheet extension, in conditions having a pH of 6.0-6.5.

123. The isolated isolated antibody of any one of embodiments 1-122, wherein the antibody competes or cross-competes for binding to h VISTA with one or more antibodies described herein, e.g., comprising the VH and VL of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-069077, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, or P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, P1-061029_Y32E_F100fE, P1-061015, P1-068736, P1-068738, P1-068740, P1-068742, P1-068744, P1-068748, P1-068750, P1-068752, P1-068754, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S), as determined, e.g., by the competitive bio-layer interferometry (BLI) epitope binning assay described in the Examples.

124. The isolated antibody of any one of embodiments 1-123, wherein the antibody bins to epitope Group A, as determined, e.g., by the competitive bio-layer interferometry (BLI) epitope binning assay described in the Examples.

125. The isolated antibody of any one of embodiments 1-124, wherein the antibody does not bind significantly to a hVISTA modified in that one or more of the following amino acid residues have been mutated: T35, Y37, K38, T39, Y41, R54, T61, F62, Q63, L65, H66, L67, H68, H69, F97, L115, V117, I119, H121, H122, S124, E125, R127, e.g., as determined by the yeast mutational analysis described in the Examples.

126. An isolated antibody that binds to hVISTA consisting of SEQ ID NO: 1 or 2, but does not bind significantly to a h VISTA modified in that one or more of the following amino acid residues have been mutated: T35, Y37, K38, T39, Y41, R54, T61, F62, Q63, L65, H66, L67, H68, H69, F97, L115, V117, I119, H121, H122, S124, E125, R127.

127. The isolated antibody of any one of embodiments 1-126, wherein the antibody does not bind significantly to a hVISTA modified in that 2, 3, 4, 5 or more of the following amino acid residues have been mutated: T35, Y37, K38, T39, Y41, R54, T61, F62, Q63, L65, H66, L67, H68, H69, F97, L115, V117, I119, H121, H122, S124, E125, R127.

128. The isolated antibody of any one of embodiments 125-127, wherein the antibody does not bind to a hVISTA modified in that one or more of the following residues have been mutated to one of the corresponding residues shown in Table 22: H68, F97, L115, V117, I119, H121, H122, S124, E125, R127.

129. An isolated antibody (Ab) that binds to hVISTA under acidic conditions, e.g., at a pH of 6.5 (as measured, e.g., by one of the assays described in the Examples), wherein the Ab inhibits the interaction between hVISTA and (a) T cells and/or (b) PSGL-1, and wherein the Ab contacts h VISTA through one or more (e.g., at least 1-3, 1-5, 1-10, 5-10, 5-15 or all) energetically important contact residues of an antibody described herein, such as P1-061015, P1-068744, P1-068748, P1-061029, P1-068761, or P1-068767, such as one or more amino acids selected from one of the following groups of energetically important contact residues: (i) V34, T35, Y37, K38, T39, Y41, S52, R54, T61, F62, Q63, L65, H66, L67, H68, H69, F97, L115, V117, I119, H121, H122, S124, E125, R127; (ii) V34, T35, Y37, T39, Y41, S52, R54, F62, L65, H66, H68, L115, V117, I119, R120, H121, H122, S124, E125; or (iii) Y37, T39, R54, F62, H66, L115 or V117, as determined, e.g., using the yeast surface display and NGS assay described in the Examples, and wherein numbering is that of mature hVISTA.

130. An isolated Ab that binds to hVISTA under acidic conditions, e.g., at a pH of 6.5 (as measured, e.g., by one of the assays described in the Examples), wherein the Ab inhibits the interaction between hVISTA and (a) T cells and/or (b) PSGL-1, and wherein the Ab contacts h VISTA through one or more (e.g., at least 1-3, 1-5, 1-10, 5-10, 5-15 or all) energetically important contact residues Y37, T39, R54, F62, H66, V117, I119 or S124, as determined, e.g., using the yeast surface display and NGS assay described in the Examples, and wherein numbering is that of mature hVISTA.

131. An isolated Ab that binds to hVISTA under acidic conditions, e.g., at a pH of 6.5 (as measured, e.g., by one of the assays described in the Examples), wherein the Ab inhibits the interaction between hVISTA and (a) T cells and/or (b) PSGL-1, and wherein the Ab contacts h VISTA through one or more (e.g., at least 1-3, 1-5, 1-10, 5-10, 5-15 or all) energetically important contact residues of P1-061015, P1-068744, P1-068748, P1-061029, P1-068761, or P1-068767 or other antibody described herein, as determined, e.g., using the yeast surface display and NGS assay described in the Examples, and wherein numbering is that of mature hVISTA.

132. The isolated Ab of any one of embodiments 1-131, wherein the Ab binds to the FG loop of hVISTA.

133. The isolated Ab of any one of embodiments 1-132, wherein the Ab binds to the histidine-rich-sheet extension of hVISTA, as determined, e.g., by crystallography, as described, e.g., in the Examples.

134 The isolated Ab of any one of embodiments 1-133, wherein the Ab contacts H121, H122 and H123 (histidine triad) of mature hVISTA (distance of, e.g., 4.0 Ångströms (Å) or less), such as through hydrogen bonds, as determined, e.g., by crystallography, as described, e.g., in the Examples.

135. The isolated Ab of any one of embodiments 1-134, wherein the Ab contacts hVISTA through VH CDR1 and VH CDR3, and for example, not significantly through VH CDR2 and/or through a VL CDR.

136. The isolated Ab of any one of embodiments 1-135, wherein amino acid residues 110 and 112 of the antibody form hydrogen bonds with H121 and H122 of hVISTA, respectively, and optionally, wherein an amino acid residue of the antibody forms a hydrogen bond with H123 of hVISTA.

137. The isolated Ab of any one of embodiments 1-136, wherein the Ab contacts hVISTA through at least one or more glutamic acid, aspartic acid or histidine residue that is located in VH CDR1, CDR2 or CDR3.

138. The isolated Ab of any one of embodiments 1-137, wherein the Ab does not bind significantly to hVISTA at neutral or physiological pH (as measured, e.g., by one of the assays described in the Examples).

139. The isolated Ab of any one of embodiments 1-138, wherein the Ab binds to hVISTA under acidic conditions, e.g., at a pH of 6.5, with a $K_D$ (or koff) that is at least 10 fold, 100 fold or 1000 fold lower than its $K_D$ and/or koff of binding to hVISTA under neutral or physiological pH (as measured, e.g., by one of the assays described in the Examples).

140. The isolated Ab of any one of embodiments 1-139, wherein the Ab does not bind significantly to hVISTA at neutral or physiological pH (as measured, e.g., by one of the assays described in the Examples).

141. An isolated antibody (Ab) that binds to hVISTA under acidic conditions, e.g., at a pH of 6.5 (as measured, e.g., by one of the assays described in the Examples), wherein the Ab:
 inhibits the interaction between h VISTA and (a) T cells and/or (b) PSGL-1 (e.g., inhibits the interaction between H153 and H154 of hVISTA having SEQ ID NO: 1 and PSGL-1 tyrosines Y46 and Y48);
 enhances T cell activation by, e.g., enhancing T cell proliferation; enhancing IFN-γ production from T cells; and/or stimulating T cell receptor mediated NF-kB signaling;
 contacts hVISTA through one or more (e.g., at least 1-3, 1-5, 1-10, 5-10, 5-15 or all) energetically important contact residues Y37, T39, R54, F62, H66, V117, I119 or S124 (Table 21) relative to SEQ ID NO: 2, as determined, e.g., using the yeast surface display and NGS assay described in the Examples; and wherein numbering is that of mature h VISTA;
 binds to the histidine-rich β-sheet extension of h VISTA, as determined, e.g., by crystallography, as described, e.g., in the Examples;
 contacts H121, H122 and/or H123 of mature hVISTA (distance of 4.0 Ångströms (Å) or less), such as through hydrogen bonds, as determined, e.g., by crystallography, as described, e.g., in the Examples;
 binds to Region 1: $_{57}$LGPVDKGHDVTF$_{68}$ (SEQ ID NO: 566); Region 2: $_{86}$RRPIRNLTFQDL$_{97}$ (SEQ ID NO: 567); and Region 3: $_{148}$VVEIRHHHSEHRVHGAME$_{165}$ (SEQ ID NO: 568) of h VISTA having SEQ ID NO: 1, and optionally wherein the binding is strongest to Region 2, as determined by MS-HDX as described in the Examples;
 competes for binding to h VISTA (two-way competition) with one or more antibodies described herein, e.g., P1-061015, P1-068744, P1-068748, P1-061029, P1-068761, P1-068767 and VISTA.4;
 contacts hVISTA through at least one or more glutamic acid, aspartic acid or histidine residue that is located in VH CDR1, CDR2 or CDR3;
 preferably accumulates in tumor tissue in human VISTA knock-in mice harboring MC38 tumors in comparison to lung, liver, and spleen tissue, or in comparison to blood;
 preferably accumulates in tumors in patients administered with the antibody (e.g. by administering antibody with a PET tracer) in comparison to lung, liver, and spleen tissues, or in comparison to blood; and/or
 has low target mediated drug disposition, leading to mean residence time (MRT) of at least 100, 200, 300, 400, 500, 600 or 700 hours, as measured, e.g., as described in the Examples.

142. An isolated antibody (Ab) that binds to hVISTA under acidic conditions, e.g., at a pH of 6.5 with a $K_D$ (and/or $k_{off}$) that is at least 10 fold, 100 fold or 1000 fold lower than its $K_D$ or $k_{off}$ of binding to hVISTA under neutral or physiological pH (as measured, e.g., by one of the assays described in the Examples), wherein the Ab:
 inhibits the interaction between hVISTA and (a) T cells and/or (b) PSGL-1 (e.g., inhibits the interaction between H153 and H154 of hVISTA having SEQ ID NO: 1 and PSGL-1 tyrosines Y46 and Y48);
 enhances T cell activation by, e.g., enhancing T cell proliferation; enhancing IFN-γ production from T cells; and/or stimulating T cell receptor mediated NF-kB signaling;
 contacts h VISTA through one or more (e.g., at least 1-3, 1-5, 1-10, 5-10, 5-15 or all) energetically important contact residues Y37, T39, R54, F62, H66, V117, I119 or S124 (Table 21) relative to SEQ ID NO: 2, as determined, e.g., using the yeast surface display and NGS assay described in the Examples; and wherein numbering is that of mature hVISTA;
 binds to the histidine-rich β-sheet extension of hVISTA, as determined, e.g., by crystallography, as described, e.g., in the Examples;
 contacts H121, H122 and/or H123 of mature hVISTA (distance of 4.0 Ångströms (Å) or less), such as through hydrogen bonds, as determined, e.g., by crystallography, as described, e.g., in the Examples;
 binds to Region 1: $_{57}$LGPVDKGHDVTF$_{68}$ (SEQ ID NO: 566); Region 2: $_{86}$RRPIRNLTFQDL$_{97}$ (SEQ ID NO: 567); and Region 3: $_{148}$VVEIRHHHSEHRVHGAME$_{165}$ (SEQ ID NO: 568) of hVISTA having SEQ ID NO: 1, and optionally wherein the binding is strongest to Region 2, as determined by MS-HDX as described in the Examples;
 competes for binding to h VISTA (two-way competition) with one or more antibodies described herein, e.g., P1-061015, P1-068744, P1-068748, P1-061029, P1-068761, P1-068767 and VISTA.4;
 contacts h VISTA through at least one or more glutamic acid, aspartic acid or histidine residue that is located in VH CDR1, CDR2 or CDR3; and/or
 has low target mediated drug disposition, leading to mean residence time (MRT) of at least 100, 200, 300, 400 500, 600 or 700 hours, as measured, e.g., as described in the Examples.

143. The isolated antibody of any one of embodiments 1-142, wherein the antibody has an isoelectric point (pI) between 6.5 and 6.8, as measured, e.g., by icIEF.

144 The isolated antibody of any one of embodiments 1-143, wherein the antibody exhibits low aggregation, e.g., an aggregation that is similar or lower than that of antibodies '029, '761 or '767 (P1-061015, P068744, P1-068748, P1-061029, P1-068761, or P1-068767, respectively), e.g., as determined in the Examples.

145. The isolated antibody of any one of embodiments 1-144, wherein the antibody exhibits a viscosity that is similar or lower than that of '029, '761 or '767, e.g., as determined in the Examples.

146 The isolated antibody of any one of embodiments 1-145, wherein the antibody exhibits a hydrodynamic radius that is similar or lower than that of '029, '761 or '767, e.g., as determined in the Examples.

147. The isolated antibody of any one of embodiments 1-146, wherein the antibody exhibits a melting temperature (Tm1) that is similar or higher than that of '029, '761 or '767, e.g., as determined in the Examples.

148. The isolated antibody of any one of embodiments 1-147, wherein the antibody exhibits an amount of high molecular weight species that is similar to or lower than that of '029, '761 or '767, e.g., as determined in the Examples.

149 The isolated antibody of any one of embodiments 1-148, which is an IgG antibody.

150. The isolated antibody of embodiment 149, which is an IgG1, IgG2 or IgG4 antibody (IgG4 optionally with S228P).

151. The isolated antibody of any one of embodiments 1-150, wherein the antibody is an effectorless antibody, e.g., lacks ADCC and/or CDC, and/or an antibody that does not significantly bind to one or more FcγRs, e.g., FcγRIII.

152. The isolated antibody of embodiment 151, wherein the constant region comprises 1-5 mutations in a wild type heavy chain constant region that reduce the effector function of the antibody and/or the ability to an bind to one or more FcγRs, e.g., FcγRIII, relative to that of the corresponding wildtype heavy chain constant region.

153. The isolated antibody of any one of embodiments 1-152, wherein the constant region of the antibody is IgG1.3, IgG1.1 or is an IgG1 with a P238K substitution (e.g., IgG1.P238K).

154. The isolated antibody of any one of embodiments 1-150, wherein the antibody has effector function and/or binds to one or more FcγRs, e.g., FcγRIII.

155. The isolated antibody of embodiment 154, wherein the antibody is afucosylated (e.g., an afucosylated IgG1 antibody).

156. The isolated antibody of embodiment 154 or 155, wherein the constant region comprises 1-5 mutations that enhance the effector function of the antibody and/or the ability to bind to one or more FcγRs, e.g., FcγRIII, relative to the corresponding wildtype constant region.

157. The isolated antibody of any one of embodiments 1-156, which is a full length antibody or an antibody comprising a full length heavy chain (with or without a C-terminal lysine) and a full length light chain.

158. The isolated antibody of any one of embodiments 1-156, which is an antigen binding fragment of the antibody.

159. The isolated antibody of anyone of embodiments 1-158, which is a multimeric (e.g., dimeric or trimeric) antibody.

160. The isolated antibody of anyone of embodiments 1-159, which is linked (e.g., covalently) to another molecule.

161. The isolated antibody of embodiment 160, wherein the other molecule is a label.

162. The isolated antibody of embodiment 160 or 161, wherein the other molecule is a peptide.

163. The isolated antibody of any one of embodiments 1-162, which is an antibody drug conjugate (ADC) or an activatable antibody.

164. An isolated nucleic acid encoding an antibody of any one of embodiments 1-163 or 206-212.

165. An isolated nucleic acid encoding the heavy chain and/or the light chain of an antibody of any one of embodiments 1-163 or 206-212.

166. A composition comprising an isolated nucleic acid encoding the heavy chain of an antibody of any one of embodiments 1-163 or 206-212 and a nucleic acid encoding the light chain of the antibody.

167. A cell comprising the isolated nucleic acid of any one of embodiments 164-166.

168. A method of preparing an antibody, comprising culturing the cell of embodiment 167 in conditions under which the antibody is expressed.

169. A composition comprising an isolated antibody, nucleic acid, composition or cell of any one of embodiments 1-168 and a pharmaceutically acceptable carrier.

170. The composition of embodiment 169, comprising a second therapeutic agent.

171 The composition of embodiment 170, wherein the second therapeutic agent is an immunostimulatory agent or a chemotherapeutic agent.

172. The composition of embodiment 171, wherein the second therapeutic agent is an immunostimulating agent that is an antagonist of an immunosuppressive molecule, e.g., the PD-1/PD-L1, a CTLA-4 and LAG-3, or an agonist of an immunostimulating molecule, e.g., GITR and OX40.

173. A method of treating cancer in a subject, comprising administering to the subject a therapeutically effective amount of a composition or isolated antibody of any one of embodiments 1-172 or 206-212 that stimulates an immune response and/or is a VISTA antagonist antibody.

174. The method of embodiment 173, wherein the subject has VISTA positive cells, e.g., in a tumor of the cancer.

175. The method of embodiment 174, wherein cells are VISTA positive infiltrating lymphocytic (e.g., T cells) or myelomonocytic cells.

176. The method of any one of embodiments 173-175, wherein the subject is first tested for the presence of VISTA positive cells in a tumor.

177. The method of any one of embodiments 173-176, wherein the method further comprises administering a second therapy.

178. The method of embodiment 177, wherein the second therapy is chemotherapy, radiotherapy, surgery or administration of a second agent.

179. The method of embodiment 178, wherein the second therapy is a second agent and the second agent is an immunostimulatory agent or a chemotherapeutic agent.

180. The method of embodiment 179, wherein the second therapeutic agent is an immunostimulatory agent that is an antagonist of an immunosuppressive molecule, e.g., the PD-1/PD-L1, an CTLA-4 and LAG-3, or an agonist of an immunostimulating molecule, e.g., GITR and OX40.

181. A method of treating an infectious disease (e.g., viral disease) in a subject, comprising administering to the subject a therapeutically effective amount of a composition or isolated antibody of any one of embodiments 1-172 or 206-212 that stimulates an immune response and/or is a VISTA antagonist.

182. A method of treating an inflammation, an inflammatory condition, and autoimmune disease, graft versus host disease or a disease that benefits from reducing an immune response, comprising administering to the subject a therapeutically effective amount of a composition or isolated antibody of any one of embodiments 1-172 or 206-212 that inhibits an immune response, e.g., T cell activation or is a VISTA agonist.

183. A method for identifying an antibody (Ab) that binds to human VISTA extracellular domain (hVISTA-ECD) at pH 6.5 or less with a $K_D$ of $10^{-7}$ M or less, comprising contacting a test Ab or a plurality of test Abs with a polypeptide comprising hVISTA-ECD or a fragment thereof comprising the IgV domain of hVISTA-ECD or comprising amino acids 20-95, 20-70, 35-70-127, or 35-127 of SEQ ID NO: 2 at pH 6.5 or less, and selecting the test Ab or Abs that bind to the polypeptide with a $K_D$ of $10^{-7}$ M or less.

184. A method for identifying an antibody (Ab) that binds to human VISTA extracellular domain (hVISTA-ECD) at pH 6.5 or less with a $k_{off}$ of $5\times10^{-3}$ $sec^{-1}$ or less, comprising contacting a test Ab or a plurality of test Abs with a polypeptide comprising hVISTA-ECD or a fragment thereof comprising the IgV domain of hVISTA-ECD or comprising amino acids 20-95, 20-70, 35-70, or 35-127 of SEQ ID NO: 2 at pH 6.5 or less, and selecting the test Ab or Abs that bind to the polypeptide with a $k_{off}$ of $5\times10^{-3}$ $sec^{-1}$ or less.

185. A method for identifying an antibody (Ab) that binds to human VISTA extracellular domain (hVISTA-ECD) at pH 6.5 with similar affinity at pH 7.0 comprising:
   a. contacting a test Ab or plurality of test Abs at pH 6.5 with a polypeptide comprising hVISTA-ECD or a fragment thereof comprising the IgV domain of h VISTA-ECD or comprising amino acids 20-95, 20-70, or 35-70, or 35-127 of SEQ ID NO:2;
   b. contacting the test Ab or plurality of test Abs at pH 7.0 with the polypeptide of (a); and
   c. selecting a test Ab if it binds to the polypeptide with a $K_D$ of $10^{-7}$ M or less at pH 6.5 and at pH 7.0.

186. A method for identifying an antibody (Ab) that binds with higher affinity to human VISTA extracellular domain (hVISTA-ECD) at pH 6.5 than at pH 7.0 comprising:
   a. contacting a test Ab or plurality of test Abs at pH 6.5 with a polypeptide comprising hVISTA-ECD or a fragment thereof comprising the IgV domain of hVISTA-ECD or comprising amino acids 20-95, 20-70, 35-70, or 35-127 of SEQ ID NO:2;
   b. contacting the test Ab or plurality of test Abs at pH 7.0 with the polypeptide of (a); and
   c. selecting a test Ab if it binds to the polypeptide with a $K_D$ or $k_{off}$ at least 2-fold lower at pH 6.5 than at pH 7.0.

187. A method for identifying an antibody (Ab) that specifically binds to human VISTA extracellular domain (hVISTA-ECD) for use in treating cancer, comprising
   a. identifying Abs that specifically bind to hVISTA-ECD at pH 6.5 or less, such as according to the methods of embodiments 183-186; and
   b. selecting the Abs of (a) that trigger or enhance an immune response in a tumor model or that inhibit tumor growth at pH 6.5 or less.

188. The method of embodiment 187, wherein step (b) comprises measuring T cell activity.

189. The method of embodiment 187 or 188, further comprising measuring the anti-tumor effect of the Ab.

190. A method for improving the anti-tumor efficacy of an antibody (Ab) that binds to human VISTA extracellular domain (hVISTA-ECD), comprising
   a. Providing an Ab that binds to hVISTA-ECD at pH 6.5 or less with an affinity that is less than a desired value;
   b. substituting 1 to 5 amino acid residues in the heavy or light chain of the Ab with a different amino acid residue (e.g, with a glutamic acid, aspartic acid or histidine residue), wherein the 1 to 5 amino acid residues are contact residues with hVISTA-ECD, e.g., one or more of amino acid residues 31, 32, 50, 57, 58, 59, 100, or 102 (numbering in SEQ ID NOs: 67, 51 or 55);
   c. Determining if the Ab obtained in (b) has higher affinity for hVISTA-ECD at pH 6.5 or less relative to the Ab of (a); and
   d. Repeating steps (a)-(c), for a number of rounds sufficient to obtain an Ab that binds to h VISTA-ECD at pH 6.5 or less with a $K_D$ of $10^{-7}$ M or less.

191. A method for improving the anti-tumor efficacy of an antibody (Ab) that binds to human VISTA extracellular domain (hVISTA-ECD), comprising:
   a. Providing an Ab that binds to hVISTA-ECD at pH 6.5 or less with an affinity that is less than a desired value;
   b. Preparing a library of variants of the Ab of (a), wherein each variant comprises a substitution of 1 to 5 amino acid residues in the heavy or light chain of the Ab with a different amino acid residue (e.g, with a glutamic acid, aspartic acid or histidine residue), wherein the 1 to 5 amino acid residues are contact residues with hVISTA-ECD, e.g., one or more of amino acid residues 31, 32, 50, 57, 58, 59, 100, or 102 (numbering in SEQ ID NOs: 67, 51 or 55);
   c. Selecting Abs of the library of variants of (b) that bind to hVISTA-ECD at pH 6.5 or less with a $K_D$ of $10^{-7}$ M or less; and
   d. Optionally testing the anti-tumor efficacy of the Abs of (c) in a tumor model.

192. A method for improving the pharmacokinetics of an antibody that binds to human VISTA extracellular domain (ECD), comprising enhancing the ability of the antibody to bind to human VISTA in acidic conditions, e.g., equal to or lower than pH 6.5.

193. A method for selecting an antibody that binds to human VISTA and having an extended half-life (good pharmacokinetic properties), wherein the method comprises selecting an antibody that binds to human VISTA in acidic conditions, e.g., equal to or lower than pH 6.5.

194. A method for improving the efficacy of antibodies that bind to human VISTA (hVISTA), comprising increasing the number of aspartic acid, glutamic acid and/or histidine residues in one or more VH CDRs of the antibody, to enhance binding of the antibody to hVISTA at acidic pH.

195. A method for isolating antibodies that bind to human VISTA (hVISTA) and have a long half-life in human blood and/or stimulate T cells in a tumor environment, comprising screening a library of antibodies binding to hVISTA for those that bind at acidic pH, but not at neutral pH.

196. The method of any one of embodiments 183-195, comprising counter selecting for those antibodies that bind at physiological pH.

197. The method of any one of embodiments 183-196, further comprising selecting antibodies that are either a VISTA antagonist or a VISTA agonist.

198. The method of any one of embodiments 183-197, comprising selecting for those antibodies that inhibit the interaction between VISTA and a VISTA co-receptor (e.g., PSGL-1) and/or the interaction between VISTA and T cells or myelomonocytic cells.

199. The method of any one of embodiments 183-198, further comprising selecting antibodies that have one or more of the properties of P1-068761 or P1-068767.

200. A method for improving the anti-tumor efficacy of an antibody (Ab) that binds to human VISTA extracellular domain (hVISTA-ECD), comprising
   a. providing an Ab that binds to hVISTA-ECD at pH 7.0, but not significantly at pH 6.5;
   b. substituting 1 to 5 amino acid residues in the heavy or light chain, e.g., CDRs, of the Ab with a different amino acid residue, wherein, e.g., the 1 to 5 amino acid residues are contact residues with hVISTA- ECD, e.g., one or more of amino acid residues 31, 32, 50, 57, 58, 59, 100, or 102 (numbering in SEQ ID NOs: 67, 51 or 55);

c. determining if the Ab obtained in (b) has higher affinity for hVISTA-ECD at pH 6.5 than at pH 7.0 and/or determining whether the Ab obtained in (b) has similar or higher affinity at pH 6.5 relative to the parent antibody (antibody of (a) and lower affinity at pH 7.0 relative to the antibody of (a); and d. repeating steps (a)-(c), for a number of rounds sufficient to obtain an Ab that binds to h VISTA-ECD at pH 6.5 or less with a $K_D$ of $10^{-7}$ M or less and binds to hVISTA-ECD at pH 7.0 or more with a $K_D$ of $10^{-6}$ M or more.

201. A method of detecting VISTA in a sample, comprising contacting the sample with a VISTA antibody of any one of embodiments 1-163 or 206-212.

202. A method of treating cancer in a subject, comprising administering to the subject an isolated antibody that binds to human VISTA (hVISTA) and inhibits the activity of h VISTA (e.g., T cell activation) and a PD1/PD-L1 pathway antagonist, which results in the increase of the number of CD4+ and CD8+ T cells, e.g., in a tumor of the subject.

203. A method of treating cancer in a subject, comprising administering to the subject an isolated antibody that binds to human VISTA (hVISTA) and inhibits the activity of hVISTA (e.g., T cell activation) and a PD1/PD-L1 pathway antagonist, which results in the reduction of the number of exhausted T cells and/or T cells expressing PD-1, LAG3 and/or TIM-3, e.g., in a tumor of the subject.

204. A method of treating cancer in a subject, comprising administering to the subject an isolated antibody that binds to human VISTA (hVISTA) and inhibits the activity of hVISTA (e.g., T cell activation) and a PD1/PD-L1 pathway antagonist, which results in the increase of the number of CD4+ and CD8+ T cells, e.g., in a tumor of the subject and a reduction of the number of exhausted T cells and/or T cells expressing PD-1, LAG3 and/or TIM-3, e.g., in a tumor of the subject and/or other features described herein.

205. The method of any one of embodiments 202-204, wherein the antibody that binds to hVISTA is an antibody described herein, such as an antibody of any one of embodiments 1-163 or 206-212.

206. The antibody, composition or a method of any one of embodiments 1-205, wherein the antibody comprises one or more (e.g., 1-5, 5-10, 10-15, 10-20 or 15-20) interactions with hVISTA at hVISTA residues shown in Table 21.

207. An antibody, composition or method of any one of embodiments 1-206, wherein the antibody comprises a glutamic acid, aspartic acid or histidine at one or more of positions 31, 32, 50, 57, 58, 59, 100, or 102, wherein the numbering is according to that in SEQ ID NOs: 67, 51 and 55.

208. An isolated antibody that binds to human VISTA extracellular domain at a pH of 6.5 and optionally not significantly at pH 7.0, wherein the antibody comprises a glutamic acid, aspartic acid or histidine at one or more of positions 31, 32, 50, 57, 58, 59, 100, or 102, wherein the numbering is according to that in SEQ ID NOs: 67, 51 and 55.

209. The antibody, composition or method of any one of embodiments 1-208, wherein the antibody does not comprise the heavy chain variable region of any of P1-069059, P1-069061, P1-069063, P1-069065, P1-069067, P1-069071, P1-069073, P1-069075, P1-069077, P1-068761, P1-068767, P1-068773, P1-068765, P1-061029, P1-068757, P1-068771, P1-068775, P1-068769, P1-068759, P1-068763, P1-061015, P1-068748, P1-068744, P1-068736, P1-068752, P1-068740, P1-068742, P1-068746, P1-068750, P1-068738, P1-068754, P1-069293, P1-069298, P1-069302, P1-069312, P1-069309, P1-069307, P1-070864, P1-070866, P1-070868, P1-070870, P1-070872, P1-070874, P1-070876, P1-070878, P1-070880, P1-070882, P1-070884, P1-070886, P1-070888, P1-070890, P1-070892, P1-070894, P1-070896, P1-070898, P1-070900, P1-070902, P1-070904, P1-070906, P1-070908, P1-070910, P1-070912, P1-070914, P1-070916, P1-070918, P1-070920, P1-070922, P1-070924, P1-070926, P1-070928, P1-070930, P1-070932, P1-068744_E31S, P1-68744_H50I, P1-68744_E59Y, P1-068744_E100S, P1-068744_E102Y, P1-068744_E31S_H50I, P1-068744_H50I_E59Y, P1-068744_E59Y_E100S, P1-068744_E100S_E102Y, P1-068744_E31S_E102Y P1-068744_E31S_E59Y, P1-068744_E31S_E100S, P1-068744_H50I_E100S, P1-068744_H50I_E102Y, P1-068744_E59Y_E102Y, P1-068748_H31S, P1-068748_H32Y, P1-068748_D57K, P1-068748_D58Y, P1-068748_D100S, P1-068748_H31S_H32Y, P1-068748_H32Y_D57K, P1-068748_D57K_D58Y, P1-068748_D58Y_D100S, P1-068748_H31S_D57K, P1-068748_H31S_D58Y, P1-068748_H31S_D100S, P1-068748_H32Y_D58Y, P1-068748_H32Y_D100S, or P1-068748_D57K_D100S, or does not comprise the heavy chain variable region of any antibody disclosed in international publication WO2018/169993.

210. The antibody, composition or method of any one of embodiments 1-209, wherein the antibody inhibits the interaction between hVISTA extracellular domain (ECD) and PSGL-1.

211. The antibody, composition or method of any one of embodiments 1-210, wherein the antibody competes for binding to hVISTA ECD with an antibody described herein (e.g., using BLI described herein), such as '761 and '767, and/or which binds to hVISTA ECD via the same amino acid residues as an antibody described herein, such as '761 and '767.

212. The antibody, composition or method of any one of embodiments 1-211, wherein the antibody interacts with the histidine triad (H121, 122 and 123 of mature hVISTA), as determined by X-ray crystallography, e.g., as determined herein.

213. The antibody, composition or method of any one of embodiments 1-212, wherein the antibody contacts at least one amino acid residue Y37, T39, R54, H65, L114, V116, S123, and E124 of SEQ ID NO: 2 of the hVISTA ECD.

214. The antibody, composition or method of any one of embodiments 1-213, wherein the antibody preferentially accumulates in tumor tissue in human VISTA knock-in mice harboring MC38 tumors in comparison to myeloid cells, in comparison to blood, and/or in comparison to liver, lung and spleen cells.

215. The antibody, composition or method of any one of embodiments 1-215, wherein the antibody preferentially accumulates in tumors of patients after administration of the antibody in comparison to myeloid cells, in comparison to blood, and/or in comparison to liver, lung and spleen cells (e.g. detected for example by administering Ab labeled with a PET tracer).

216. An isolated antibody described herein, comprising 1, 2, 3 or more germline reversion mutations in the heavy chain and/or the light chain.

Yet further embodiments include:

1. A method for identifying an Ab that binds to hVISTA-ECD at pH 6.5 or less with a $K_D$ of $10^{-7}$ M or less, comprising contacting a test Ab or a plurality of test Abs with a polypeptide comprising hVISTA-ECD or a fragment thereof comprising the IgV domain of hVISTA-ECD or comprising amino acids 20-95, 20-70, or 35-70 of SEQ ID NO: 2 at pH 6.5 or less, and selecting the test Ab or Abs that bind to the polypeptide with a $K_D$ of $10^{-7}$ M or less.
2. A method for identifying an Ab that binds to hVISTA-ECD at pH 6.5 or less with a $k_{off}$ of $10^{-3}$ $sec^{-1}$ or less, comprising contacting a test Ab or a plurality of test Abs with a polypeptide comprising hVISTA-ECD or a fragment thereof comprising the IgV domain of h VISTA-ECD or comprising amino acids 20-95, 20-70, or 35-70 of SEQ ID NO: 2 at pH 6.5 or less, and selecting the test Ab or Abs that bind to the polypeptide with a $k_{off}$ of $10^{-3}$ $sec^{-1}$ or less.
3. A method for identifying an Ab that specifically binds to hVISTA-ECD at pH 6.5 with similar affinity at pH 7.0 comprising:
   a. contacting a test Ab or plurality of test Abs at pH 6.5 with a polypeptide comprising hVISTA-ECD or a fragment thereof comprising the IgV domain of hVISTA-ECD or comprising amino acids 20-95, 20-70, or 35-70 of SEQ ID NO: 2;
   b. contacting the test Ab or plurality of test Abs at pH 7.0 with the polypeptide of (a); and
   c. selecting a test Ab if it binds to the polypeptide with a $K_D$ of $10^{-7}$ M or less at pH 6.5 and at pH 7.0.
4. A method for identifying an Ab that binds with higher affinity to h VISTA-ECD at pH 6.5 than at pH 7.0 comprising:
   a. contacting a test Ab or plurality of test Abs at pH 6.5 with a polypeptide comprising hVISTA-ECD or a fragment thereof comprising the IgV domain of hVISTA-ECD or comprising amino acids 20-95, 20-70, or 35-70 of SEQ ID NO: 2;
   b. contacting the test Ab or plurality of test Abs at pH 7.0 with the polypeptide of (a); and
   c. selecting a test Ab if it binds to the polypeptide with a $K_D$ at least 2-fold lower at pH 6.5 than at pH 7.0.
5. A method for identifying an Ab that specifically binds to hVISTA-ECD for use in treating cancer, comprising
   a. identifying Abs that specifically bind to hVISTA-ECD at pH 6.5 or less, such as according to the methods of embodiments 32-35; and
   b. selecting the Abs of (a) that trigger or enhance an immune response in a tumor model or that inhibit tumor growth at pH 6.5 or less.
6. The method of embodiment 38, wherein step (b) comprises measuring T cell activity.
7. The method of embodiment 38 or 39, further comprising measuring the anti-tumor effect of the Ab.
8. A method for improving the anti-tumor efficacy of an Ab that binds to hVISTA-ECD, comprising
   a. Providing an Ab that binds to hVISTA-ECD at pH 6.5 or less with an affinity that is less than a desired value, e.g., with a $K_D$ of $10^{-7}$ M or more, e.g., $10^{-6}$M, $10^{-5}$ M or more and/or $k_{off}$ of $10^{-2}$ $sec^{-1}$ or more;
   b. Replacing 1 to 5 amino acid residues in the heavy or light chain of the Ab with a different amino acid residue, wherein the 1 to 5 amino acid residues are contact residues with h VISTA-ECD;
   c. Determining if the Ab obtained in (b) has higher affinity for h VISTA-ECD at pH 6.5 or less relative to the Ab of (a); and
   d. Repeating steps (a)-(c), for a number of rounds sufficient to obtain an Ab that binds to h VISTA-ECD at pH 6.5 or less with a $K_D$ of $10^{-7}$ M or less.
9. A method for improving the anti-tumor efficacy of an Ab that binds to hVISTA-ECD, comprising:
   a. Providing an Ab that binds to hVISTA-ECD at pH 6.5 or less with an affinity that is less than a desired value, e.g., with a $K_D$ of $10^{-7}$ M or more, e.g., $10^{-6}$M, $10^{-5}$ M or more and/or $k_{off}$ of $10^{-2}$ $sec^{-1}$ or more;
   b. Preparing a library of variants of the Ab of (a), wherein each variant comprises a substitution of 1 to 5 amino acid residues in the heavy or light chain of the Ab with a different amino acid residue, wherein the 1 to 5 amino acid residues are contact residues with hVISTA-ECD;
   c. Selecting Abs of the library of variants of (b) that bind to hVISTA-ECD at pH 6.5 or less with a $K_D$ of $10^{-7}$ M or less; and optionally,
   d. Testing the anti-tumor efficacy of the Abs of (c) in a tumor model.
10. A method for improving the pharmacokinetics of an antibody that binds to human VISTA ECD, comprising enhancing the ability of the antibody to bind to human VISTA in acidic conditions, e.g., equal to or lower than pH 6.5.
11. A method for selecting an antibody that binds to human VISTA and having an extended half-life (good pharmacokinetic properties), wherein the method comprises selecting an antibody that binds to human VISTA in acidic conditions, e.g., equal to or lower than pH 6.5.

Further exemplary embodiments are provided in the claims further below.

EXAMPLES

The examples discussed below are intended to be purely exemplary of the invention and should not be considered to limit the invention in any way. The examples are not intended to represent that the experiments below are all or the only experiments performed. Efforts have been made to ensure accuracy with respect to numbers used (for example, amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1: VISTA's Extracellular Domain is Exceptionally Rich in Histidines

This example shows that VISTA's extracellular domain is exceptionally rich in histidine residues, that these histidine residues are evolutionarily conserved, and that they may contribute to receptor-ligand interactions involving VISTA.

The amino acid sequences of the extracellular domains (ECDs) of immunoglobulin domain-containing proteins were extracted from the uniprot and swiss-prot databases and analyzed for histidine content. FIG. 1A depicts the results of this analysis as a graph. For each protein, the frequency of histidine residues as a percentage of all extracellular domain amino acid residues is plotted on the y-axis, and the total number of extracellular domain amino acid residues is plotted on the x-axis. The diameter of each data point corresponds to the total number of histidine residues in the extracellular domain of each protein. VISTA (labeled) contains an exceptionally high frequency of histidine residues in its extracellular domain.

The evolutionary conservation of histidine residues in VISTA was then assessed. FIG. 1B shows the amino acid reference sequences of human, cynomolgus macaque, and mouse VISTA were aligned, excluding the signal peptides ("Sig"), transmembrane domains ("TMD") and intracellular domains. Histidine residues that are conserved across all three species are bolded and underlined. Histidine residues that are conserved across human and cyno VISTA are bolded without underlining. Many of VISTA's extracellular domain histidine residues are evolutionarily conserved, suggesting an important biological role for VISTA's high histidine content.

Figure 1C:
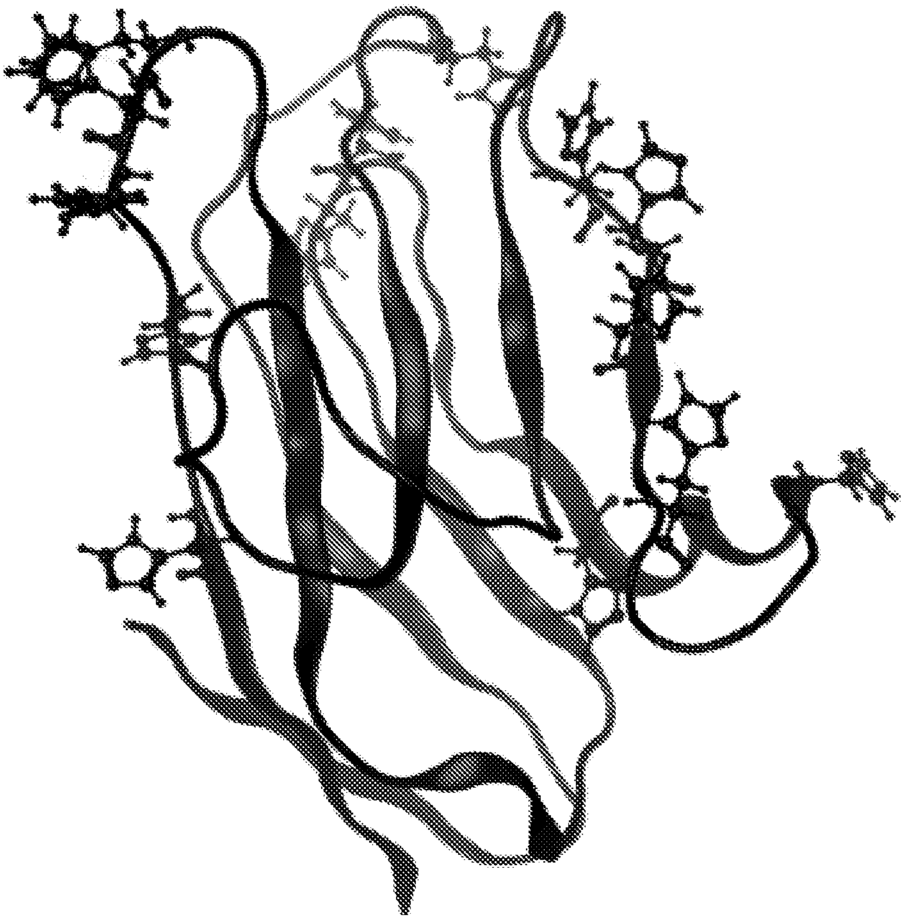

A three-dimensional model of the hVISTA IgV domain was created based on sequence homology analysis to available solved structures in the PDB database. The model, shown in FIG. 1C, indicates that many histidines in VISTA's ECD are exposed at the surface of the molecule, where they may play a role in ligand binding as well as in antibody recognition. Histidine residues are depicted as balls and sticks.

Example 2: Histidine Protonation May Regulate VISTA Receptor-Ligand Engagement and Immunosuppressive Activity in Tumors and Other Acidic Microenvironments This Example describes histidine protonation in response to physiologically relevant acidic pH, as well as a model in which VISTA extracellular domain histidines confer counter-receptor or ligand selectivity for acidic pH rather than physiological pH.

Figure 2A:
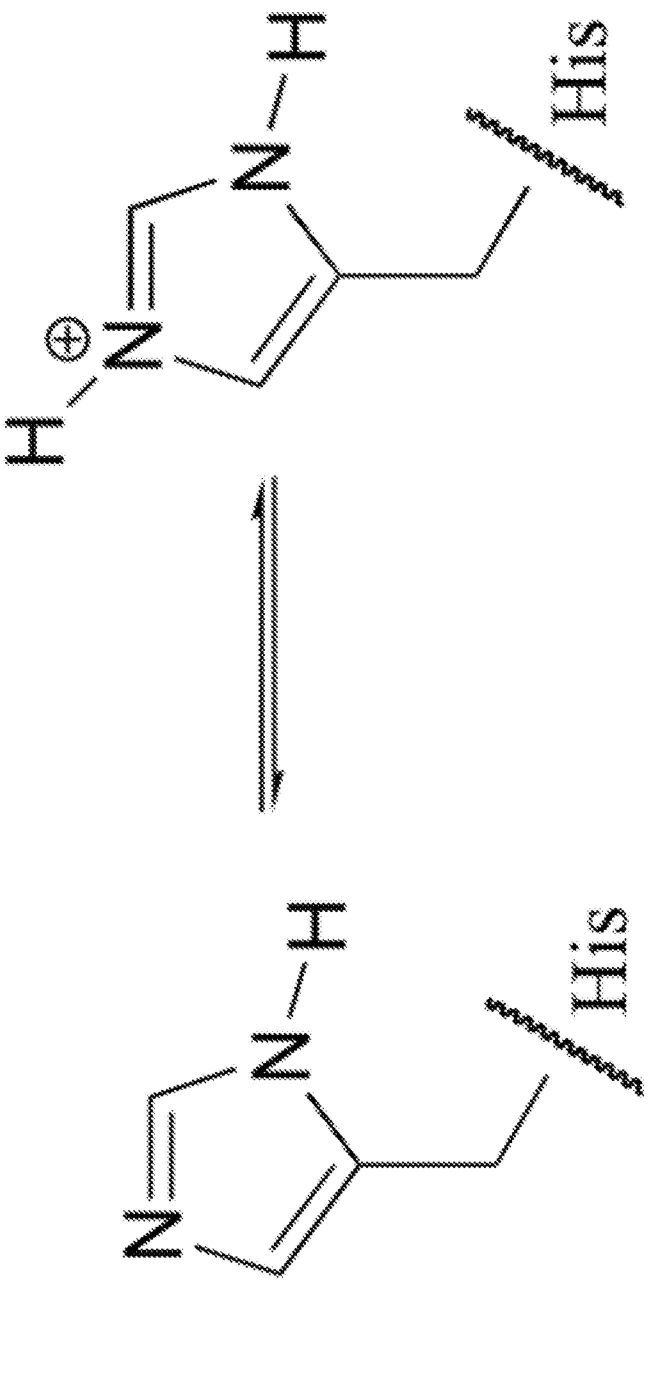
FIGS. 2A-B show a model in which the histidine residues in VISTA's extracellular domain confer counter-receptor selectivity for acidic pH rather than physiological pH.

FIG. 2A shows the equilibrium between the lack of, and the presence of, protonation of the pyrrole ammonium group (NH) in a histidine residue. The pKa of histidine in solution is 6.5, indicating that histidine residues are more likely to be protonated at pH 6.5 and lower, and thus, positively charged, than at higher pH. The increase in positive charge at the surface of the VISTA ECD as a result of protonation may affect receptor or ligand binding as well as VISTA structure and/or function. Thus, changes in pH may also modify antibody binding epitopes and/or result in varied antibody affinities.

Figure 2B:
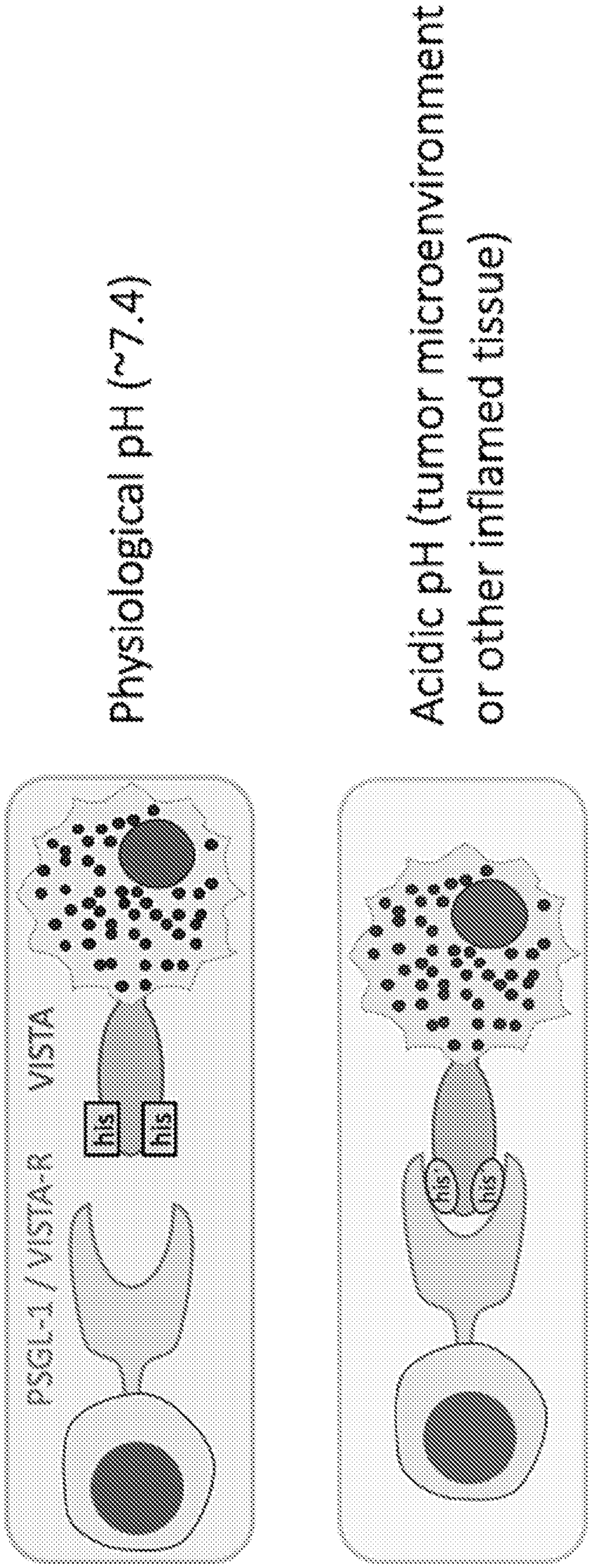

FIG. 2B shows a model in which VISTA engages PSGL-1 or other counter-receptors and ligands ("VISTA-R") selectively at acidic pH. At physiological pH, such as in the blood, histidine residues on VISTA's ECD are expected to be non-protonated. As a result, VISTA binding to PSGL-1 or other counter-receptors and ligands is neglible at physiological pH. In contrast, in locations that tend to have an acidic extracellular pH, such as tumor microenvironments or sites of inflammation, acidic pH may partially or fully drive VISTA ECD histidine protonation and thus enable VISTA engagement with PSGL-1 or other counter-receptors and ligands. Accordingly, antibodies that bind strongly to VISTA-ECD proteins at acidic pH ranges may be more effective in inhibiting VISTA activity in tumors.

Example 3: VISTA is Expressed by Myelomonocytic Cells in Tumors

This Example shows that VISTA is frequently expressed by myelomonocytic cells in tumors, including macrophages, dendritic cells, and granulocytes.

Figure 3:
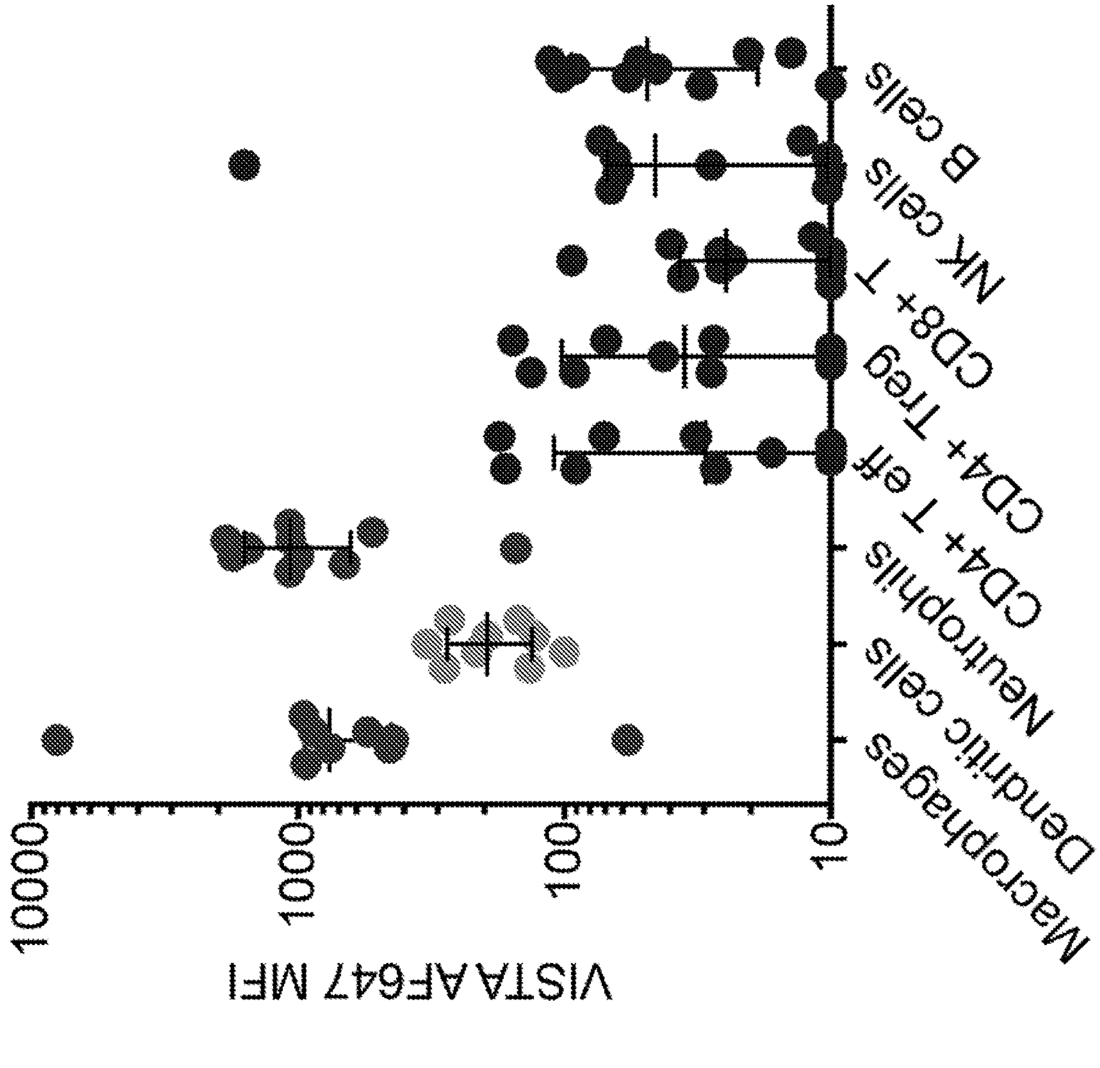
FIG. 3 shows the level of VISTA surface expression (mean fluorescence intensity (MFI) of anti-VISTA antibody staining) on tumor-infiltrating macrophages, dendritic cells, neutrophils, CD4+ effector T cells, CD4+ regulatory T cells, CD8+ T cells, natural killer (NK) cells, and B cells. VISTA is expressed on many tumor-infiltrating leukocytes, particularly myeloid cells. Tumor microenvironments are often acidic, enabling VISTA to engage counter-receptors and ligands.

Surgically resected non-small cell lung carcincoma, renal clear cell carcinoma, melanoma, colorectal carcinoma, and other tumor samples were washed in ice-cold PBS, cut into approximately 15 $mm^3$-sized pieces, and suspended in ice-cold RPMI-1640 media (Fisher Scientific catalog number 11875093) supplemented with 2% heat-inactivated FBS and 2 mM EDTA (Fisher Scientific 15575020). Each sample was transferred to a large clearance glass dounce (Tenbroeck Tissue Grinders) and ground until the tissue pieces were visually disassociated. The suspensions were filtered through 70 M nylon mesh and centrifuged. The supernatants were discarded and the cell pellets were re-suspended in room-temperature PBS supplemented with 0.1% bovine serum albumin and 250 mg/mL sterile-filtered DNase 1 (grade II, from bovine pancreas, Roche catalog number 10104159001) for 3 minutes at room temperature. The cells were then washed in ice-cold supplemented RPMI and re-suspended in ice-cold PBS. A cell viability dye was added and the cells were incubated on ice in the dark. After 20 minutes, non-specific antibody staining was blocked by adding 4% normal rat serum, 4% normal mouse serum, 20% human serum from AB plasma, and 1:125 diluted Human TruStain FcX™ (Biolegend catalog number 422302). The cells were stained with fluorophore-conjugated antibodies against HLA-DR (BD Biosciences catalog number 564040), CD8 (Fisher Scientific catalog number 46-0087-42), CD14 (Biolegend catalog number 325620), CD45 (Biolegend catalog number 304017), CD4 (BD Biosciences catalog number 563875), CD11c (BD Biosciences catalog number 744439), CD15 (BD Biosciences catalog number 563142), PD-1 (BD Biosciences catalog number 565299), CD3 (BD Biosciences catalog number 565515), CD56 (Fisher Scientific catalog number 61-0567-42), CD19 (BD Biosciences catalog number 564977), and VISTA (VISTA antibody 3 conjugated to AlexaFluor™ 647, Fisher Scientific catalog number A20186) suspended in Brilliant Stain Buffer (BD Biosciences catalog number 562794) for 30 minutes on ice in the dark. The stained cells were washed in ice-cold PBS, fixed (Fisher Scientific catalog number 00-5523-00), and acquired on a flow cytometer. Data were analyzed using FlowJo™ software (BD Biosciences). As shown in FIG. 3, VISTA cell surface expression was highest on macrophages and granulocytes, moderate on dendritic cells, and low on T cells, natural killer cells, and B cells.

Example 4: VISTA Cell Binding Exhibits Acidic pH Selectivity

This Example shows that multimerized human VISTA ECD binds more efficiently to stimulated human CD4+ T cells and human peripheral blood mononuclear cells at acidic pH than at neutral or physiological pH, and that this binding can be blocked by an anti-human VISTA locking antibody. Acidic pH-selective-dimerized mouse VISTA ECD binding to mouse splenocytes is also shown.

Figure 4A:
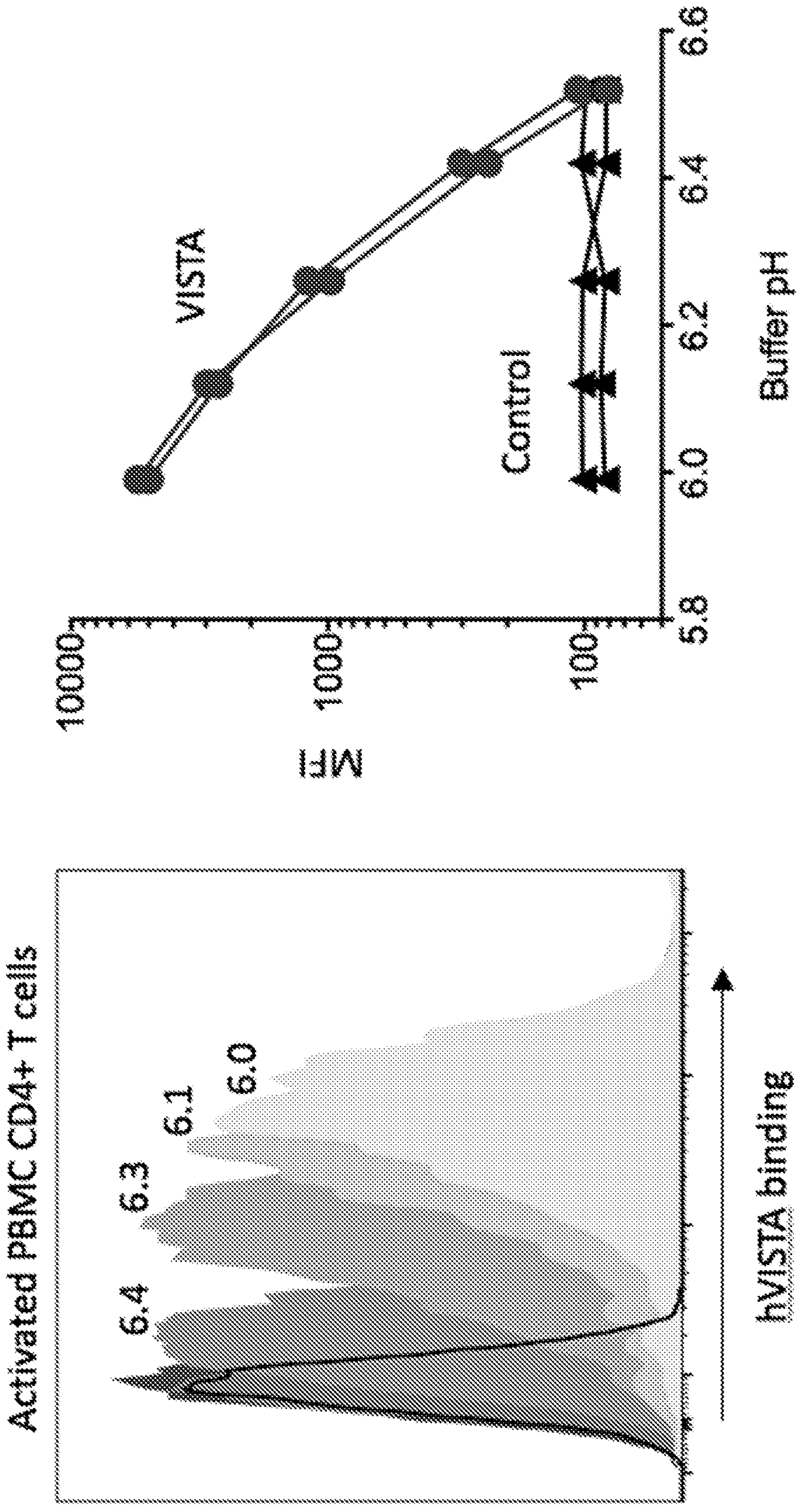
FIGS. 4A-G show that VISTA selectively binds to leukocytes and to PSGL-1 at acidic pH, with little or no binding at neutral pH, and that this binding can be blocked by an anti-VISTA antibody.

Human CD4+ T cells were enriched from healthy donor blood by RosetteSep™ (Stemcell catalog number 15062) and stimulated in vitro for approximately four days with Human T-Activator CD3/CD28 Dynabeads™ (Fisher Scientific catalog number 111.32D) and recombinant human IL-2 (Peprotech catalog number 200-02) in RPMI-1640 supplemented with 10% heat-inactivated FBS, Glutamax™ (Fisher Scientific catalog number 35050061), non-essential amino acids (Fisher Scientific 11140050), sodium pyruvate (Fisher Scientific catalog number 11360070), and 2-mercaptoethanol (Fisher Scientific 21985023). The activated CD4+ T cells were stained with monobiotinylated h VISTA ECD molecules (Phe 33-Ala 194 (Accession #AAH20568)-polyhistidine; AcroBiosystems, Inc. B75-H82F3) loaded at a 28:1 molar ratio onto Phycoerythrin (PE)-conjugated streptavidin dextramers (catalog number DX01-PE) diluted into Hank's Buffered Salt Solution (HBSS, Fisher Scientific catalog number 14025134) acidified to various pH with mM MES (Sigma, 1317-100ML) for 30 minutes at room temperature. As a control, activated CD4+ T cells were stained with PE-conjugated streptavidin dextramers that were not loaded with hVISTA. The stained cells were washed with HBSS+MES and acquired on a flow cytometer. Data were analyzed using FlowJo™ software (BD Biosciences). The results, depicted in FIG. 4A, show that hVISTA did not bind CD4+ T cells better than the control at pH >6.5. In contrast, hVISTA exhibited progressively stronger binding to CD4+ T cells at pH<6.5. Left, from darker gray to lighter, the filled histograms depict binding at pH 7.0, 6.5, 6.4, 6.3, 6.1, and 6.0. Some histograms are labeled with their corresponding pH. Non-VISTA control multimer binding at pH 6.0 is shown as the unfilled histogram. Right, graphed PE mean fluorescence intensities (MFI) of CD4+ T cells stained with hVISTA-loaded dextramers (circles) or with non-loaded dextramers (triangles) at various pH.

Figure 4B:
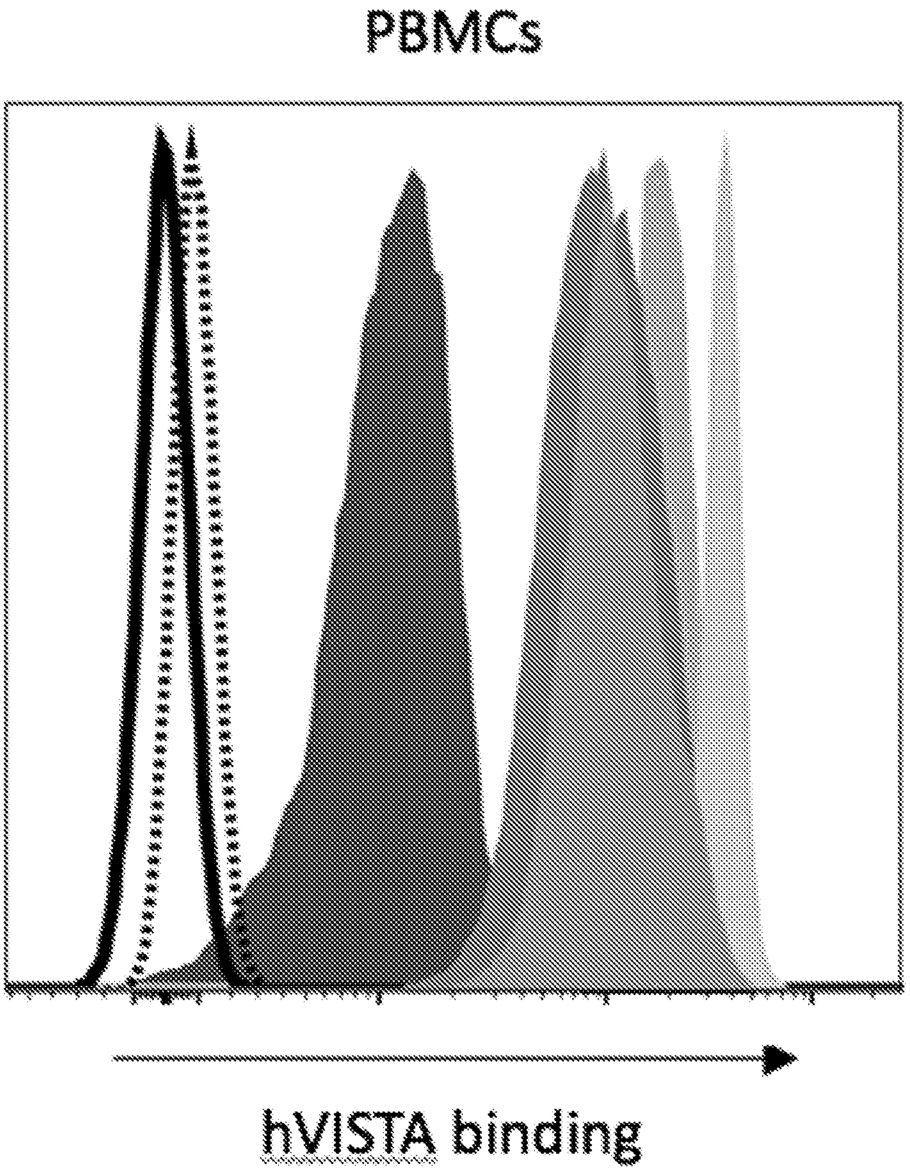
Figure 4C:
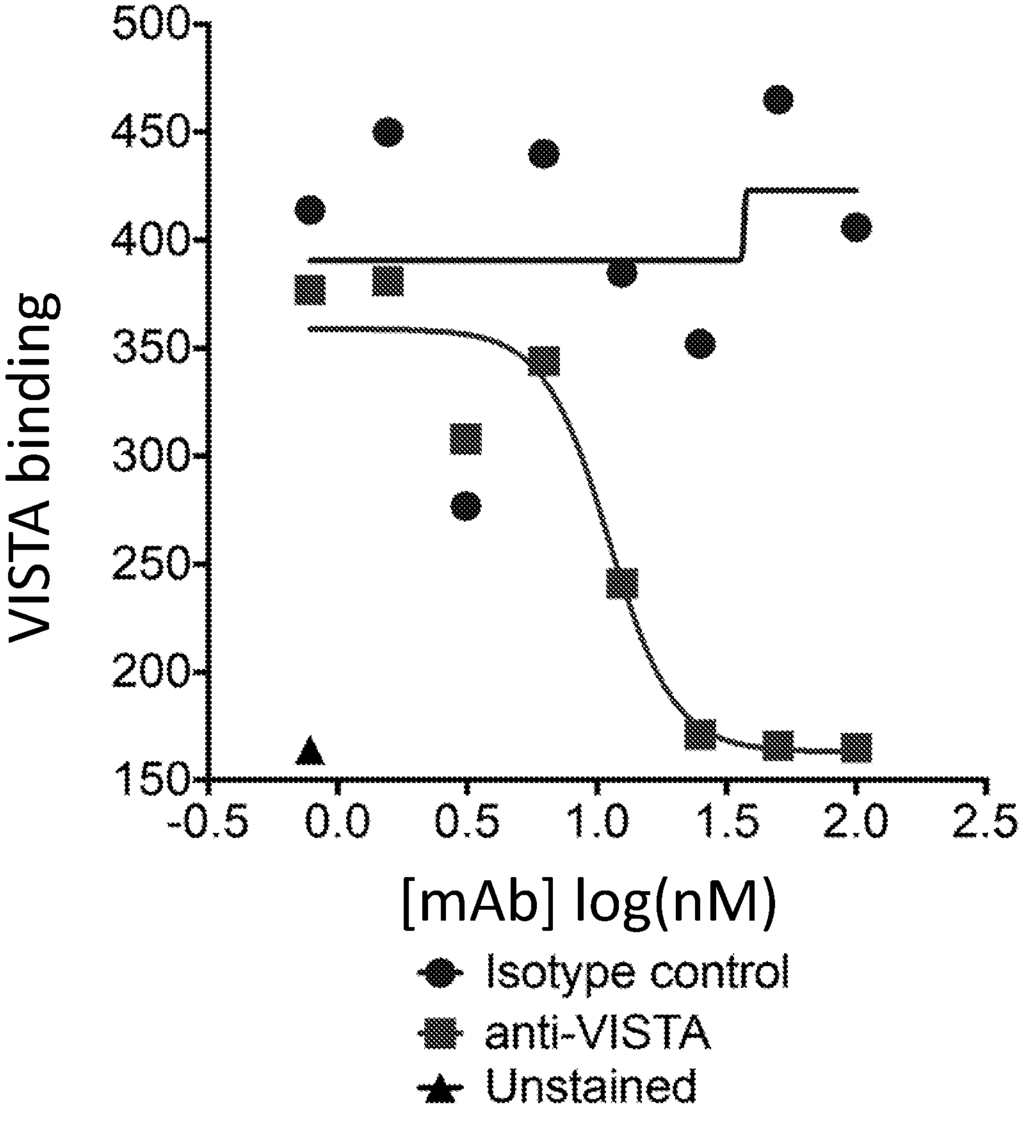

Peripheral blood mononuclear cells (PBMC) were enriched from healthy donor blood by ficoll gradient centrifugation (Ficoll-Paque Plus, GE Life Sciences catalog number 17144003) and stained with hVISTA-loaded dextramers (also referred to as multimers) and fluorophore-conjugated diluted in HBSS+MES buffers as described above. FIG. 4B shows filled histograms that depict, from darker gray to lighter, binding at pH 6.0 to CD19+ B cells, CD4+ T cells, CD8+ T cells, CD56+NK cells, and CD14+ monocytes. The unfilled, solid border and dotted border histograms depict binding at pH 7.4 to total PBMC lymphocytes and monocytes respectively. FIGS. 4F and 4G show that VISTA binds to both monocytes and neutrophils, and does so more strongly at pH 6.0 than at pH 7.4. The results show that hVISTA can bind many leukocytes at acidic pH but not significantly at physiological pH.

Activated human CD4+ T cells were stained with h VISTA multimers at pH 6 in the presence of titrated anti-human VISTA antibody or an isotype-matched non-VISTA-specific antibody. The results, graphed in FIG. 4C, show VISTA multimer MFI relative to antibody concentration. Anti-hVISTA antibody (VISTA antibody 3; squares), but not the non-VISTA-specific control antibody (circles), blocked hVISTA binding to activated CD4+ T cells in a concentration-dependent manner. The PE MFI of CD4+ T cells that were not stained with hVISTA-loaded multimers is included as a control (single triangle).

Figure 4D:
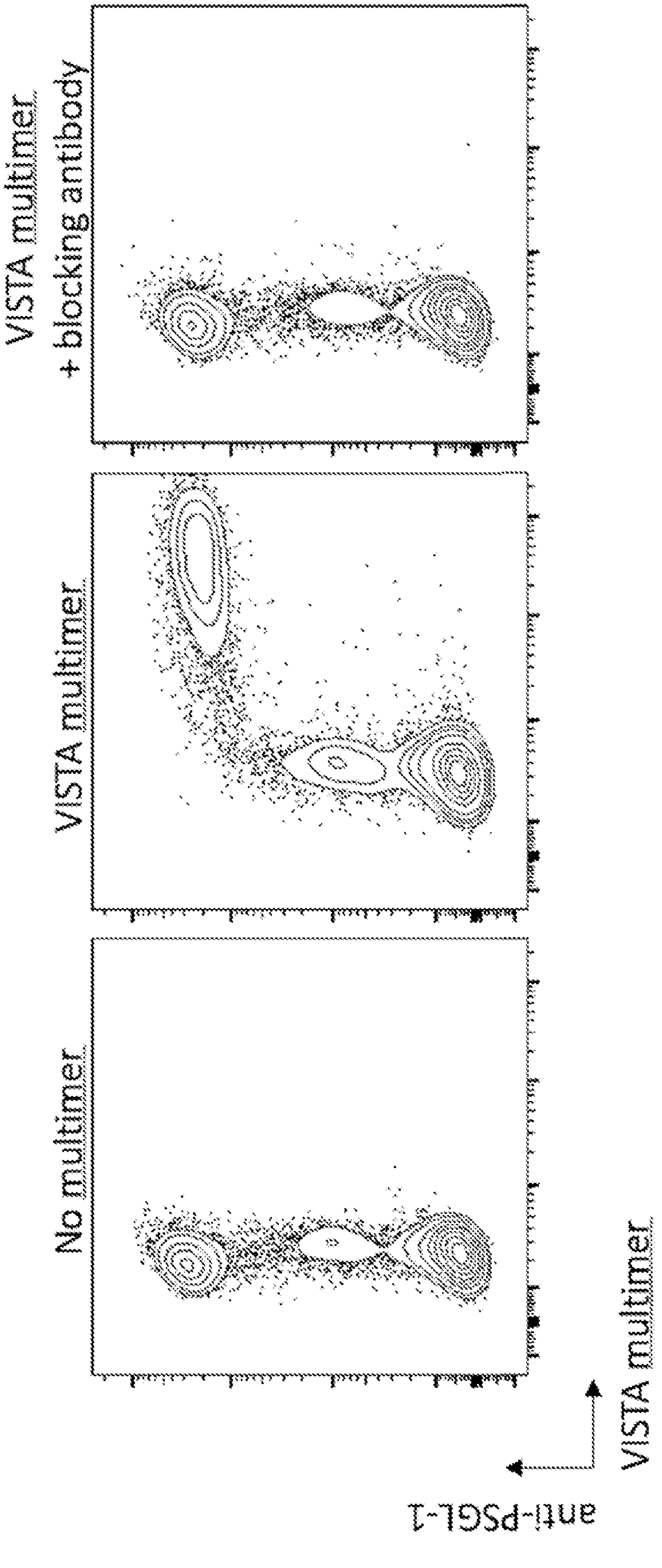

FIG. 4D shows representative two-dimensional flow cytometry plots of VISTA multimer staining at pH 6.0 to heparan sulfate-mutant Chinese Hamster Ovary (CHO) cells (line pGSD-677, American Type Culture Collection) that were transfected to express full length human PSGL-1 (SEQ ID NO: 3; nucleic acid NM_003006.4). Staining was performed in the presence or absence of a titrated anti-VISTA blocking antibody (mAb 3). Cells left unstained by VISTA multimers are shown as a control. PSGL-1 antibody (BD Biosciences catalog number 562758) staining is plotted on the y-axis, and VISTA multimer staining is plotted on the x-axis.

Figure 4E:
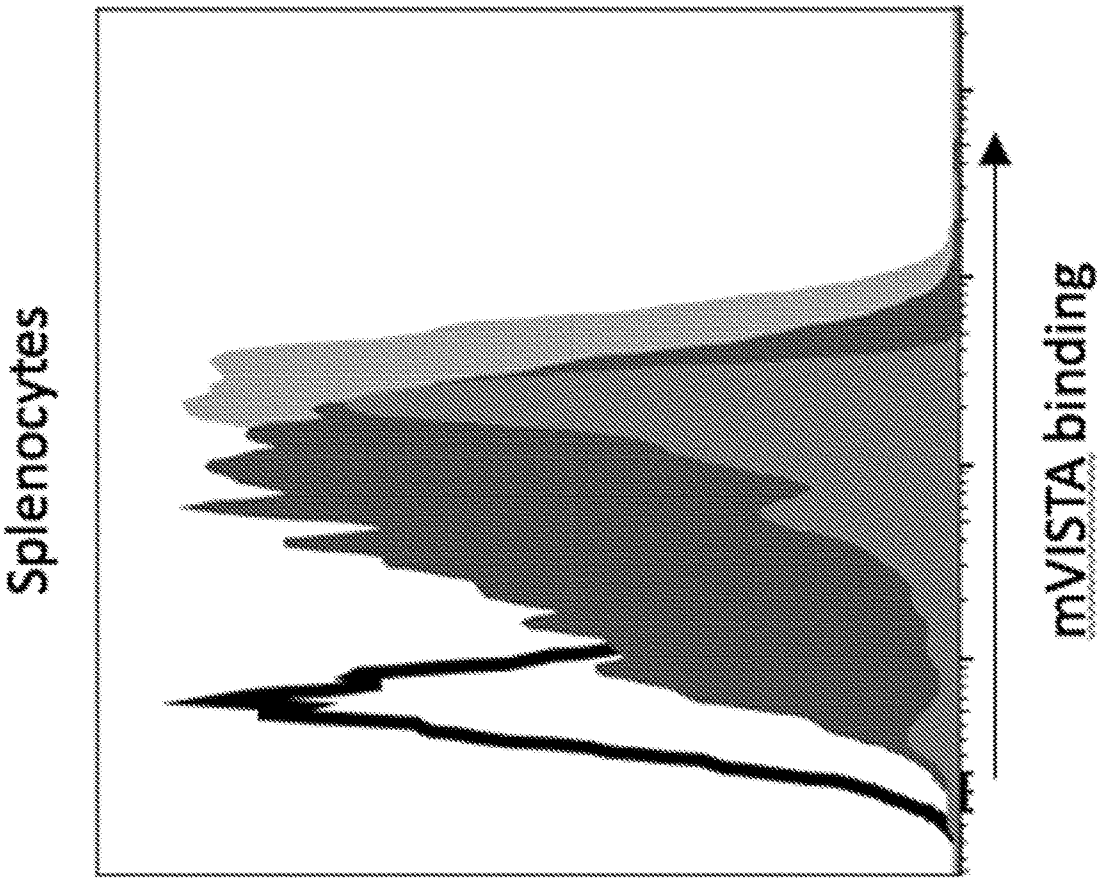
Figures 4F, 4G:
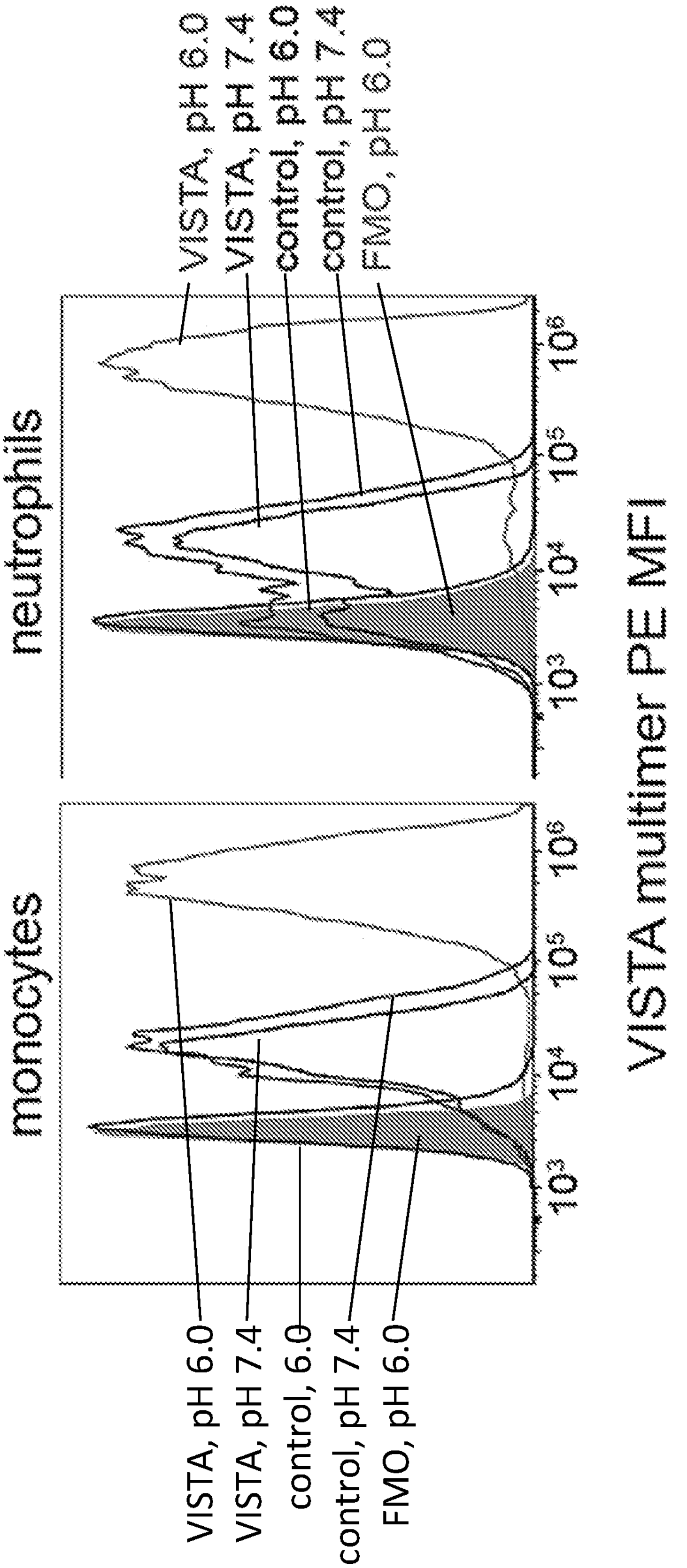

Splenocytes were collected from C57BL6/J mice (Jackson Laboratory catalog number 000664) and stained with m VISTA ECD/human IgG Fc (Fragment, crystallizable) chimeric fusion proteins followed by fluorophore-conjugated anti-human IgG Fc secondary antibodies (Jackson Immunoresearch catalog number 109-065-098) at pH 6.0 or 7.4. The results, depicted by histogram in FIG. 4E, show that m VISTA binds murine splenocytes more efficiently at pH 6.0 than at physiological pH (approximately pH 7.4). From darker gray to lighter, the filled histograms depict binding at pH 6.0 to CD8+ T cells, CD11b+ myeloid cells, and CD4+ T cells. The unfilled histogram depicts binding at pH 7.4 to total splenocytes.

Example 5: VISTA Mediates Cell: Cell Adhesion and Immune Suppression Selectively at Acidic pH This Example shows that VISTA mediates cell: cell adhesion and suppresses T cell activation more potently at acidic pH than at neutral or physiological pH.

Figure 5A:
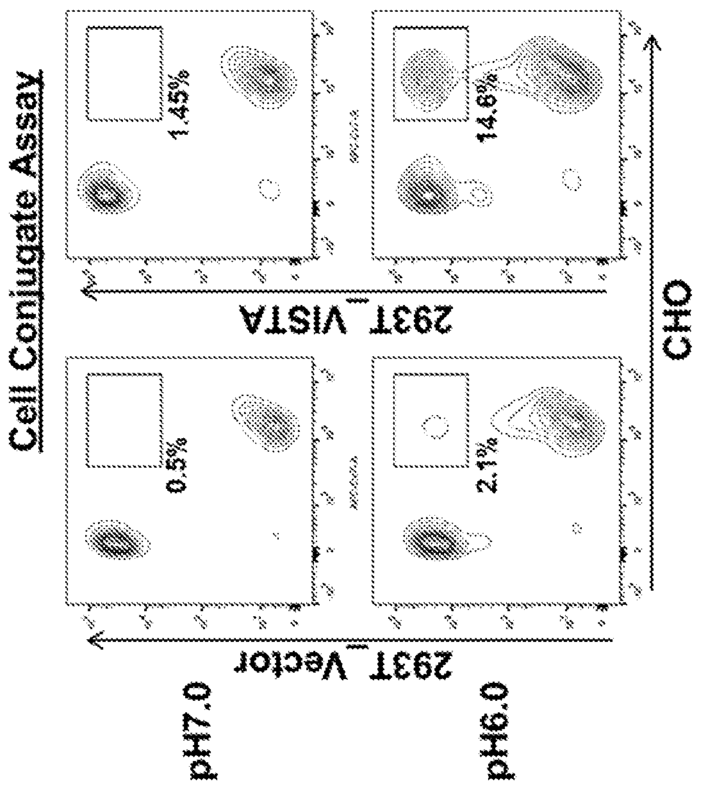
FIGS. 5A-D show that VISTA mediates T cell suppression and cell: cell adhesion preferentially at acidic pH, and that both effects can be reversed with an anti-VISTA blocking antibody.
Figure 5B:
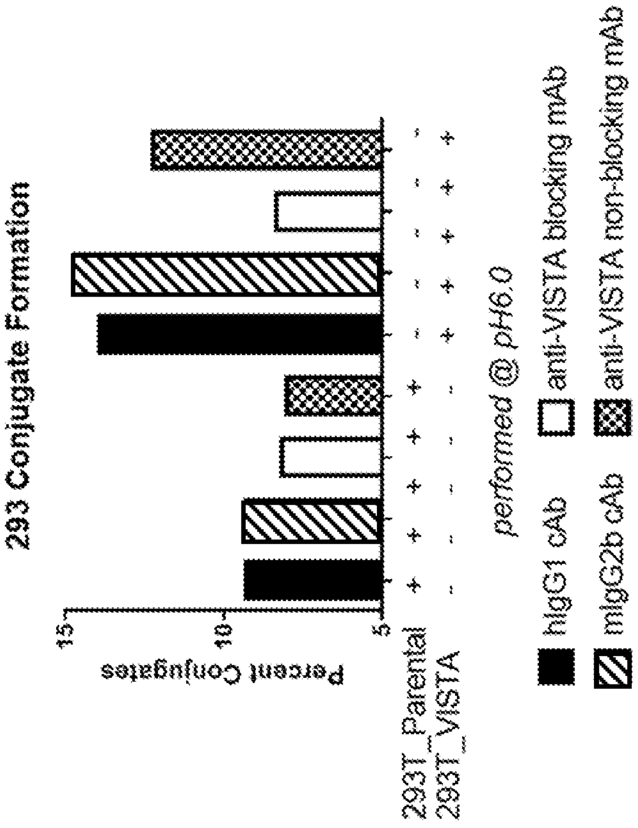

An acidic pH-compatible flow cytometry-based cell/cell conjugate assay was established. 293T cells (an immortalized human embryonic kidney cell line, ATCC catalog number CRL-3216) ectopically expressing full-length human VISTA or vector were labeled with CFSE (Carboxyfluorescein succinimidyl ester, Fisher Scientific catalog number C34554). CHO cells were labeled with CellTrace™ Far Red (Fisher Scientific catalog number C34564). The Vector or VISTA 293T cells were then mixed at a 1:1 ratio with CHO cells in pH7.0 or pH6.0 buffers and incubated for 1 hour at room temperature. The formation of CHO and 293T cell/cell conjugates was assessed by flow cytometry. The results shown in FIGS. 5A-B demonstrate that VISTA-expressing 293T cells preferentially adhere to CHO cells at acidic pH and that inclusion of an anti-VISTA blocking antibody (VISTA mAb 3; white bars) inhibits VISTA mediated cell/cell adhesion.

Figure 5C:
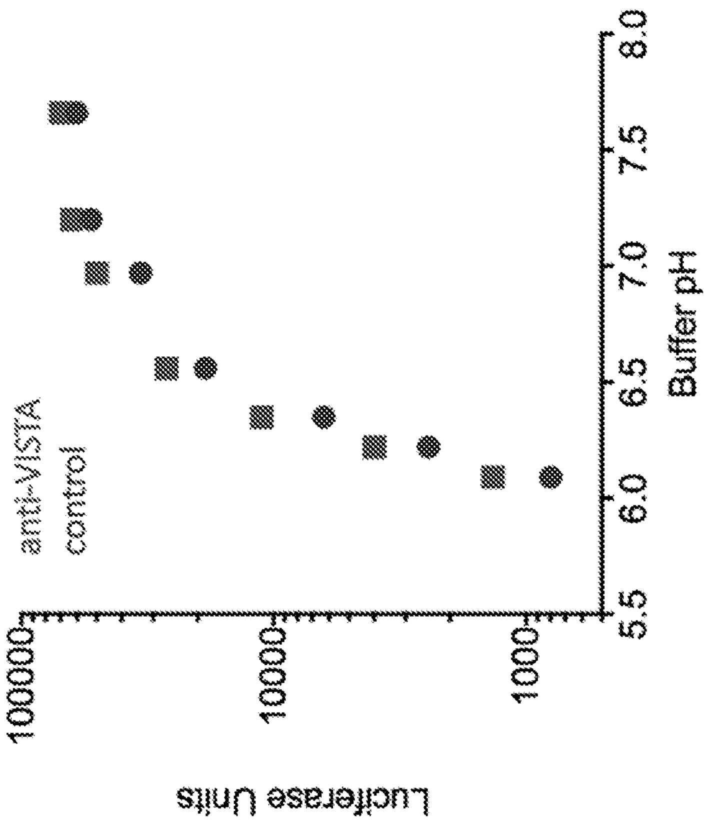
Figure 5D:
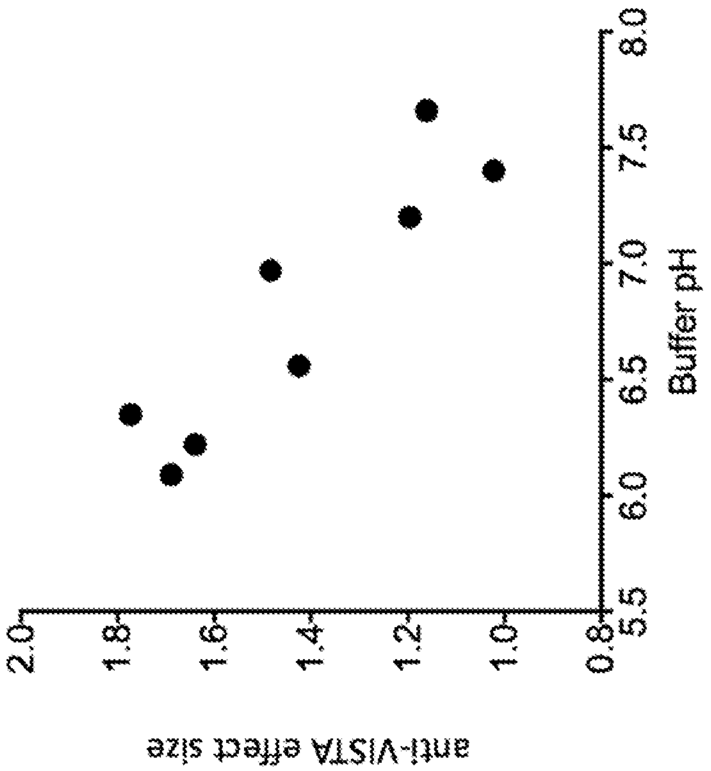

An acidic pH-compatible T cell suppression assay was established. Jurkat cells (an immortalized human T cell line, ATCC catalog number TIB-152) expressing an NFkB promoter driven luciferase reporter were co-cultured in HBSS+MES buffers of various pH with 293T cells (an immortalized human embryonic kidney cell line, ATCC catalog number CRL-3216) ectopically expressing full-length human VISTA and a single-chain variable fragment of the anti-human T cell receptor agonist antibody clone OKT3 at a 10:1 Jurkat: 293T cell ratio. An anti-VISTA blocking antibody (VISTA mAb 3) or an isotype-matched non-VISTA-specific control antibody were added at 10 μg/mL to the co-cultures. After incubation, Jurkat T cell activation was quantified by measuring luciferase activity (1 second interval Promega catalog number G7940). The results are shown in FIG. 5C-D. FIG. 5C shows a plot of luciferase units in Jurkats treated with anti-VISTA (squares) or control antibody (circles) at different pH. FIG. 5D shows a plot of the luciferase signal in anti-VISTA antibody-treated co-cultures divided by the luciferase signal in control antibody-treated co-cultures at each pH tested. The results show that VISTA-mediated T cell suppression is most potent at acidic pH.

Example 6: VISTA Trafficks Through Intracellular Recycling Endosomes

This Example shows that VISTA can be found in intracellular endosomes, particularly Rab11+ recycling endosomes, and can recycle to and from the cell surface via endosomal trafficking. The strength with which an anti-VISTA antibody binds VISTA at acidic pH influences its capacity to remain bound to VISTA during endosomal trafficking.

Figure 6A:
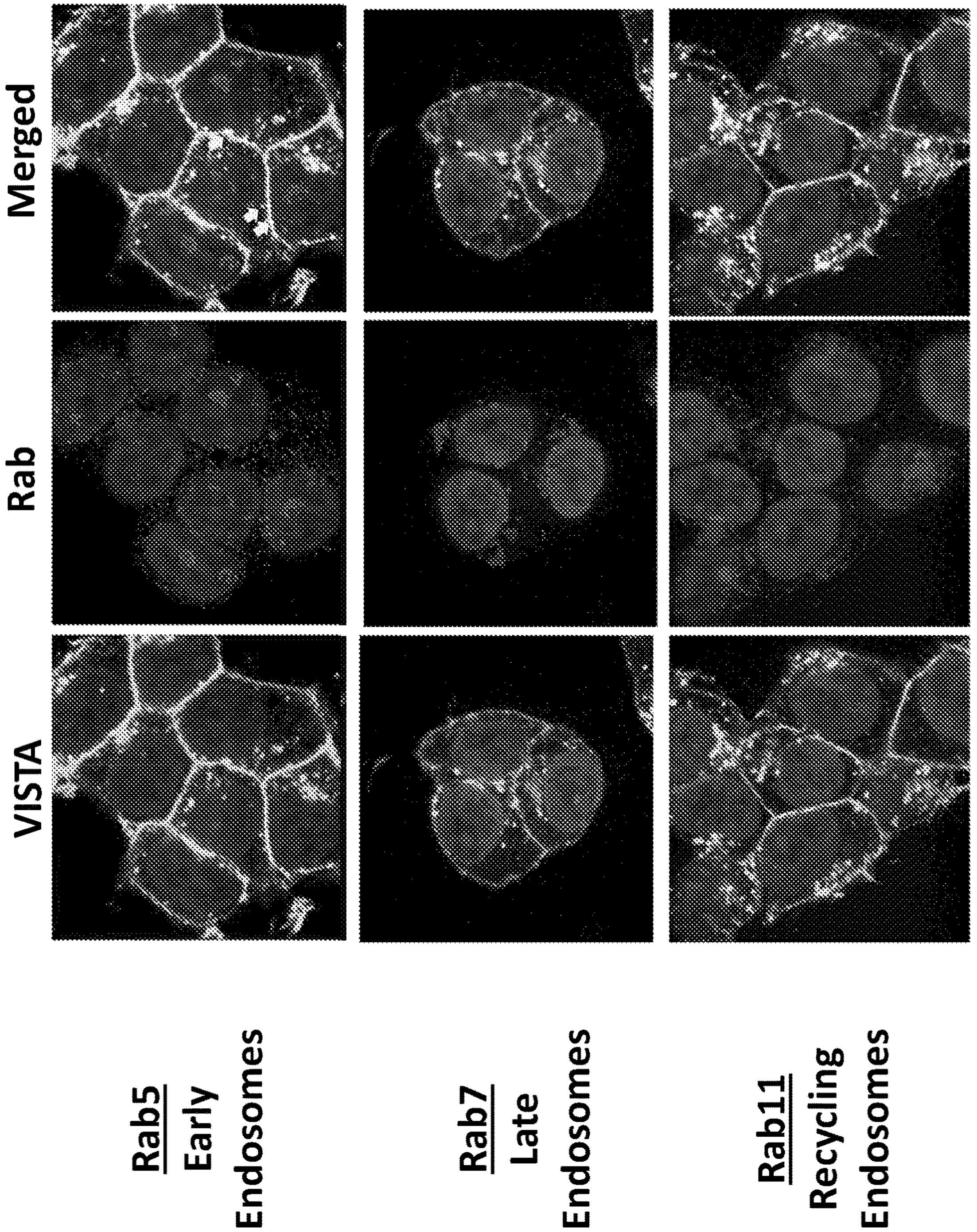
FIGS. 6A-G show that VISTA can be found in intracellular endosomes, particularly Rab11+ recycling endosomes, and can recycle to and from the cell surface via endosomal trafficking.
Figure 6B:
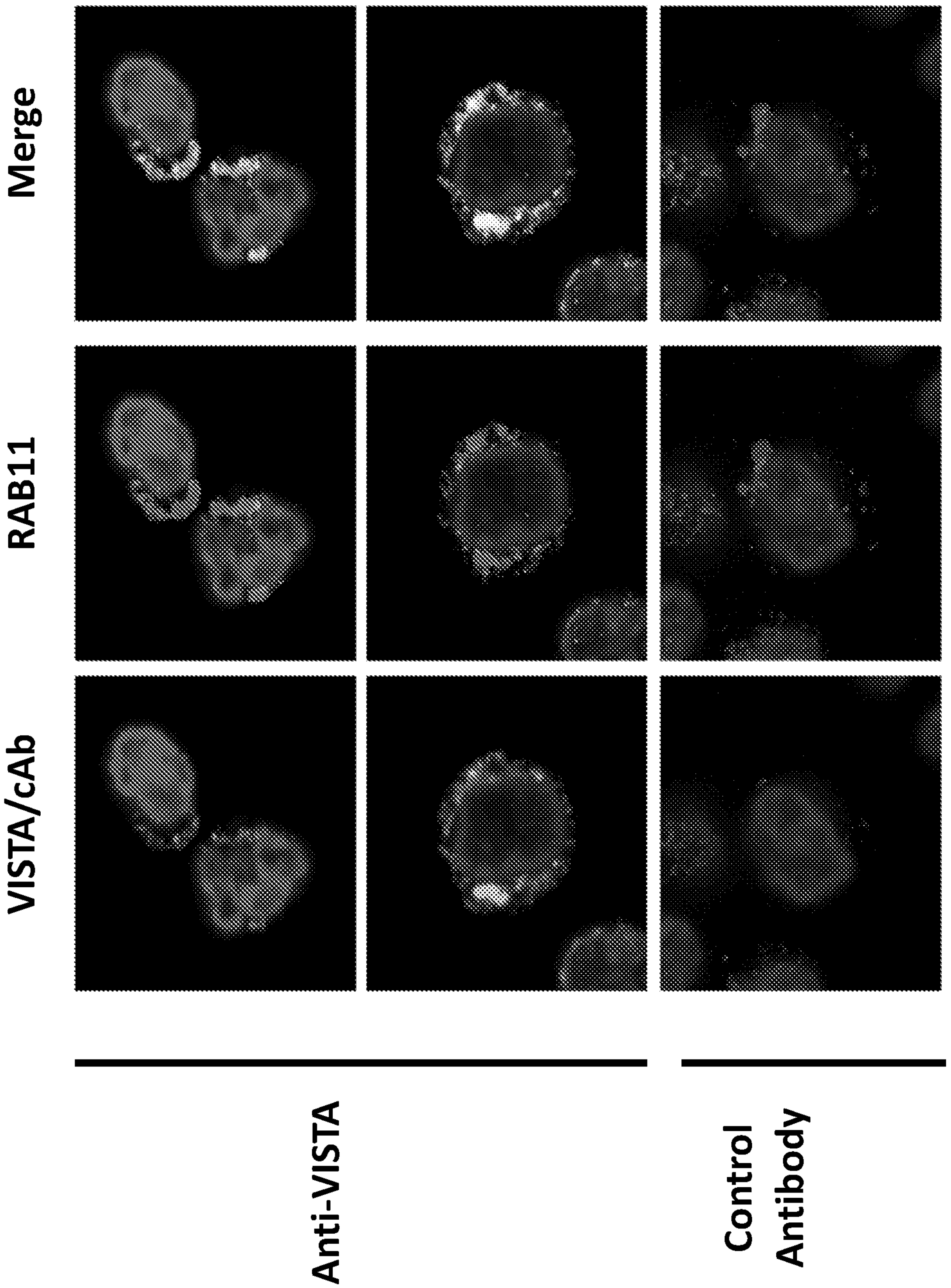

Monocytes were isolated from PBMCs by magnetic activated cell sorting. Both monocytes and 293T cells were then fixed in 4% paraformaldehyde and stained intracellularly for Rab5, Rab7 or Rab11, and with an anti-VISTA or control antibody. The control antibody ("cAb"), which is a non-VISTA-binding antibody of the same isotype as the anti-VISTA antibody, does not detectably bind monocytes or 293T cells expressing human VISTA. Anti-VISTA and control antibodies were directly labeled with Alexa488. Rab antibodies were detected using an Alexa594 anti-rabbit Ig secondary antibody. Hoescht 33342 staining was performed to identify cell nuclei. Images were captured using a spinning disk confocal microscope. FIG. 6A shows co-localization of VISTA, Rab5 (early endosome marker), Rab7 (late endosome marker), and Rab11 (recycling endosome marker) within 293T cells expressing human VISTA. FIG. 6B shows co-localization of VISTA and Rab11 within human monocytes. Intracellular VISTA is co-localized with Rab11+ recycling endosomes.

To assess VISTA's capacity to recycle through endosomes, an endolysosome-dependent antibody drug conjugate killing assay was performed with three anti-hVISTA antibodies (VISTA mAb 1, 2 and 3) with varying VISTA binding properties at physiological and acidic pH. An SPR assay was performed first to compare hVISTA binding profiles for all three VISTA antibodies at pH 7.4, 6.7 and 6.0. VISTA antibodies were captured on a Biacore® T100 (GE Healthcare) CM5 biosensor containing immobilized Protein A, then 100 nM hVISTA-ECD (amino acids 32-193 of SEQ ID NO: 1 with a 7×His tail, i.e.,

```
AFKVATPYSL YVCPEGQNVT LTCRLLGPVD KGHDVTFYKT

WYRSSRGEVQ TCSERRPIRN LTFQDLHLHH GGHQAANTSH

DLAQRHGLES ASDHHGNFSI TMRNLTLLDS GLYCCLVVEI

RHHHSEHRVH GAMELQVQTG KDAPSNCVVY PSSSQESENI

Figure 6C:
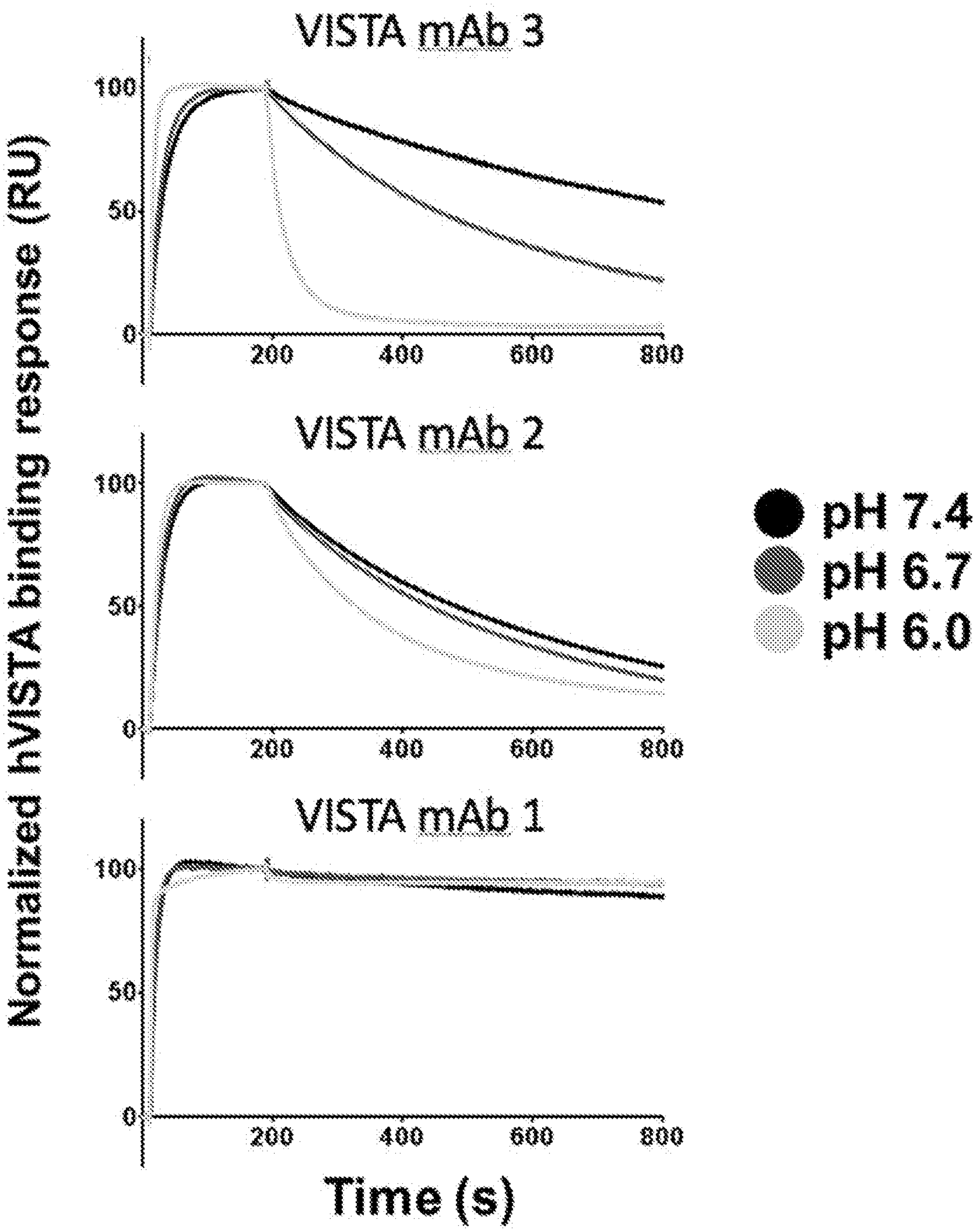

TAHHHHHHH; SEQ ID NO: 325)
``` was flowed in PBST running buffer at the indicated pH at 37° C. Reference-subtracted sensorgrams were normalized to the 'binding' report point and plotted. VISTA antibody 3, "mAb 3", (FIG. 6C, top) exhibited the greatest degree of VISTA binding impairment at acidic pH, followed by VISTA antibody 2, "mAb 2," (FIG. 6C, middle), which was only moderately impaired. VISTA antibody 1, "mAb 1," maintained strong VISTA binding at acidic and physiological pH conditions (FIG. 6C, bottom).

Figure 6D:
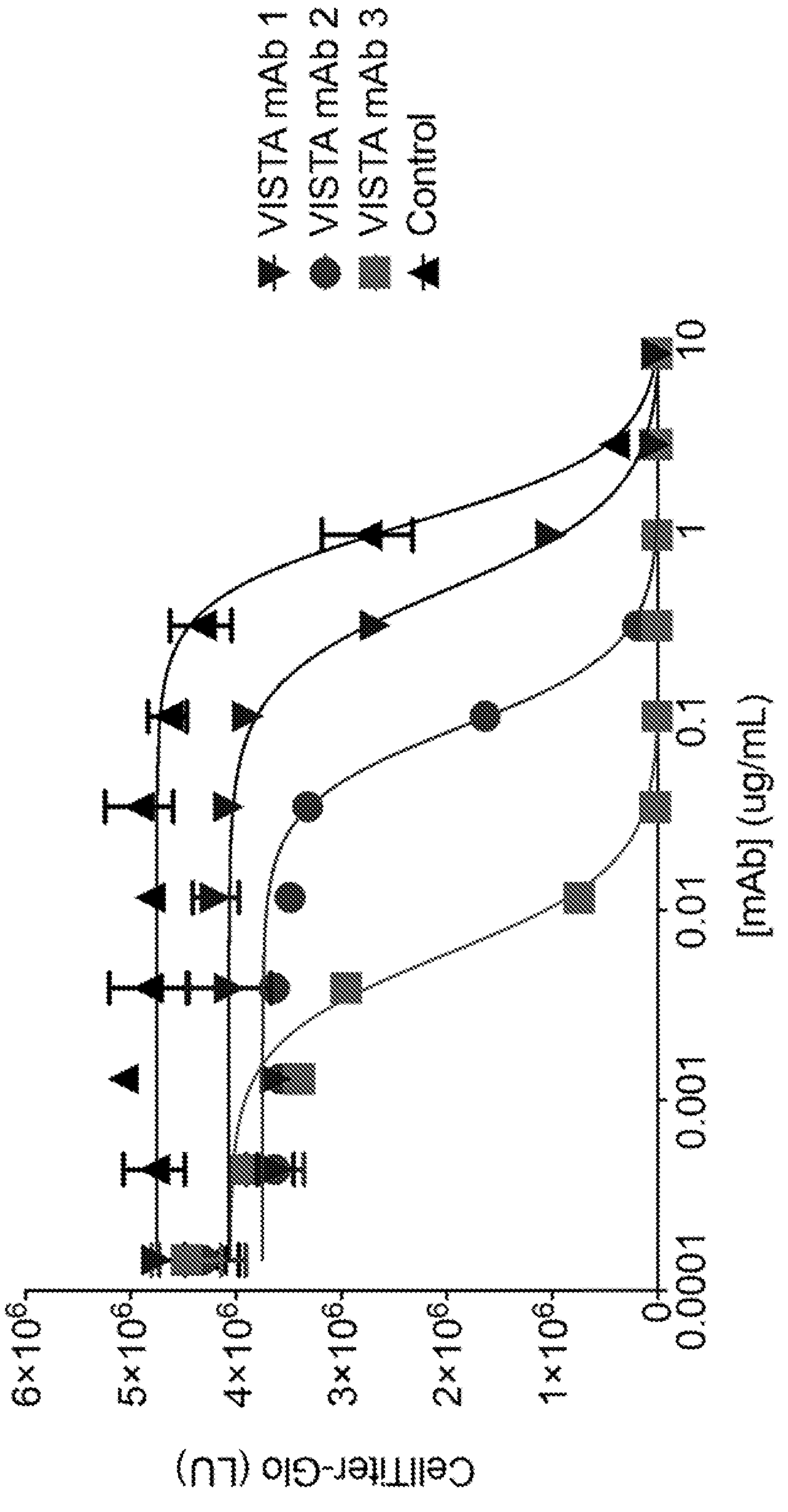

The endolysosome-dependent antibody drug conjugate killing assay was performed as follows. AML3 cells (an immortalized human monocyte cell line, ATCC CRL-9589), which endogenously express human VISTA, were cultured with titrated anti-VISTA antibodies or a non-VISTA-specific control antibody and an anti-human IgG secondary antibody that was conjugated to a cathepsin B-sensitive linker and a cytotoxic tubulysin payload. Because Cathepsin B is predominantly active in late endosomes and lysosomes, anti-VISTA antibodies that recycle with VISTA through early endosomes and recycling endosomes will experience low levels of linker cleavage and as a result low levels of the cytotoxic payload release and cell death. Anti-VISTA antibodies which become disassociated from VISTA in acidic endosomes and sorted into late endosomes and lysosomes will experience higher levels of linker cleavage. Cell viability was measured by Cell Titer Glo® (Promega catalog number G7573) after five days in culture. FIG. 6D shows the results of this assay, with AML3 viability (Cell Titer Glo) plotted on the y-axis and primary antibody concentrations plotted on the x-axis. Calculated EC50s for primary antibodies: VISTA antibody 1, inverted triangles, 0.485 μg/mL; VISTA antibody 2, circles, 0.092 μg/mL; VISTA antibody 3, squares, 0.006 μg/mL; Control, triangles, 1.085 μg/mL. Antibody potency was inversely correlated with anti-VISTA antibody binding at acidic pH.

Figure 6E:
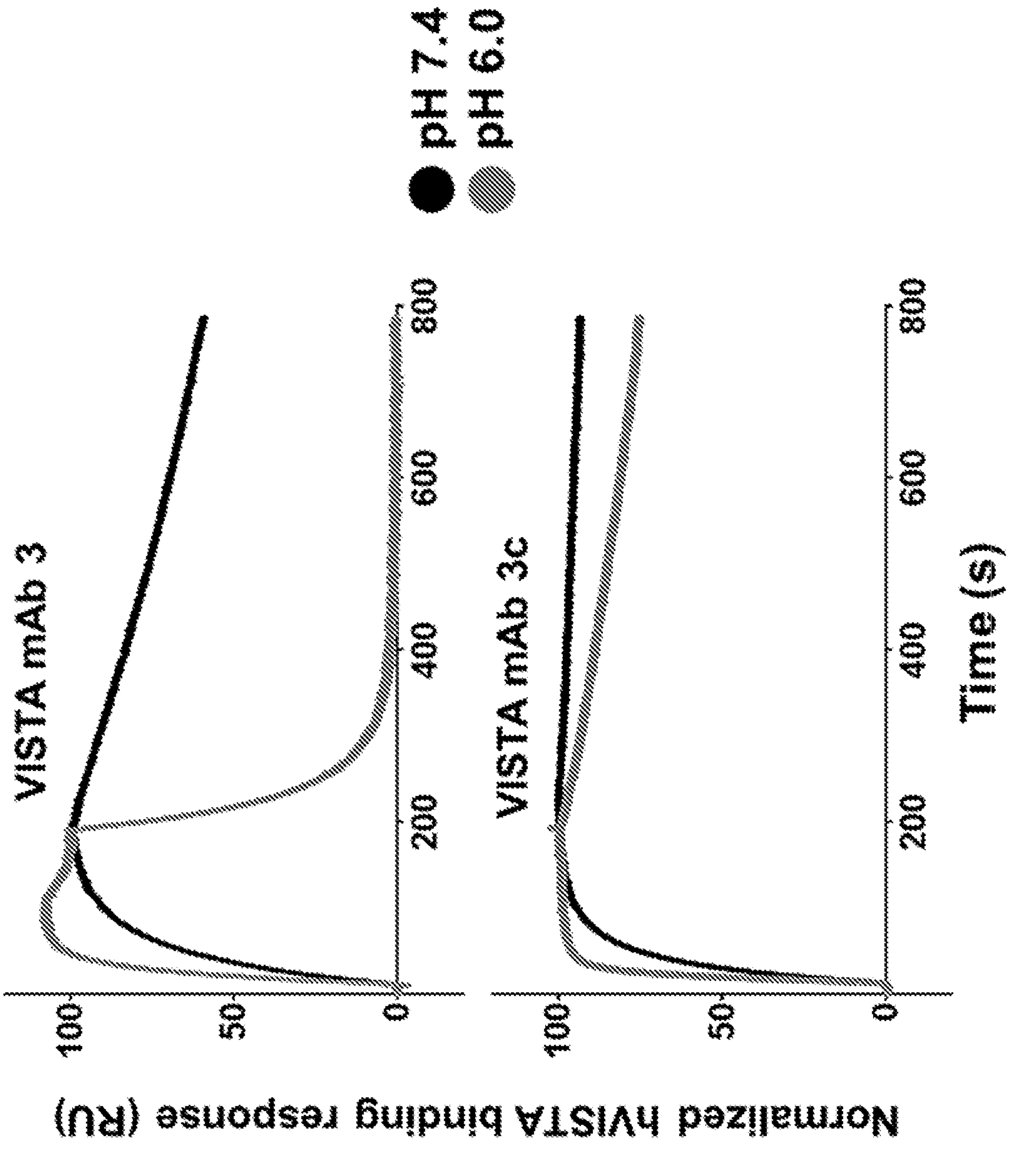
Figure 6F:
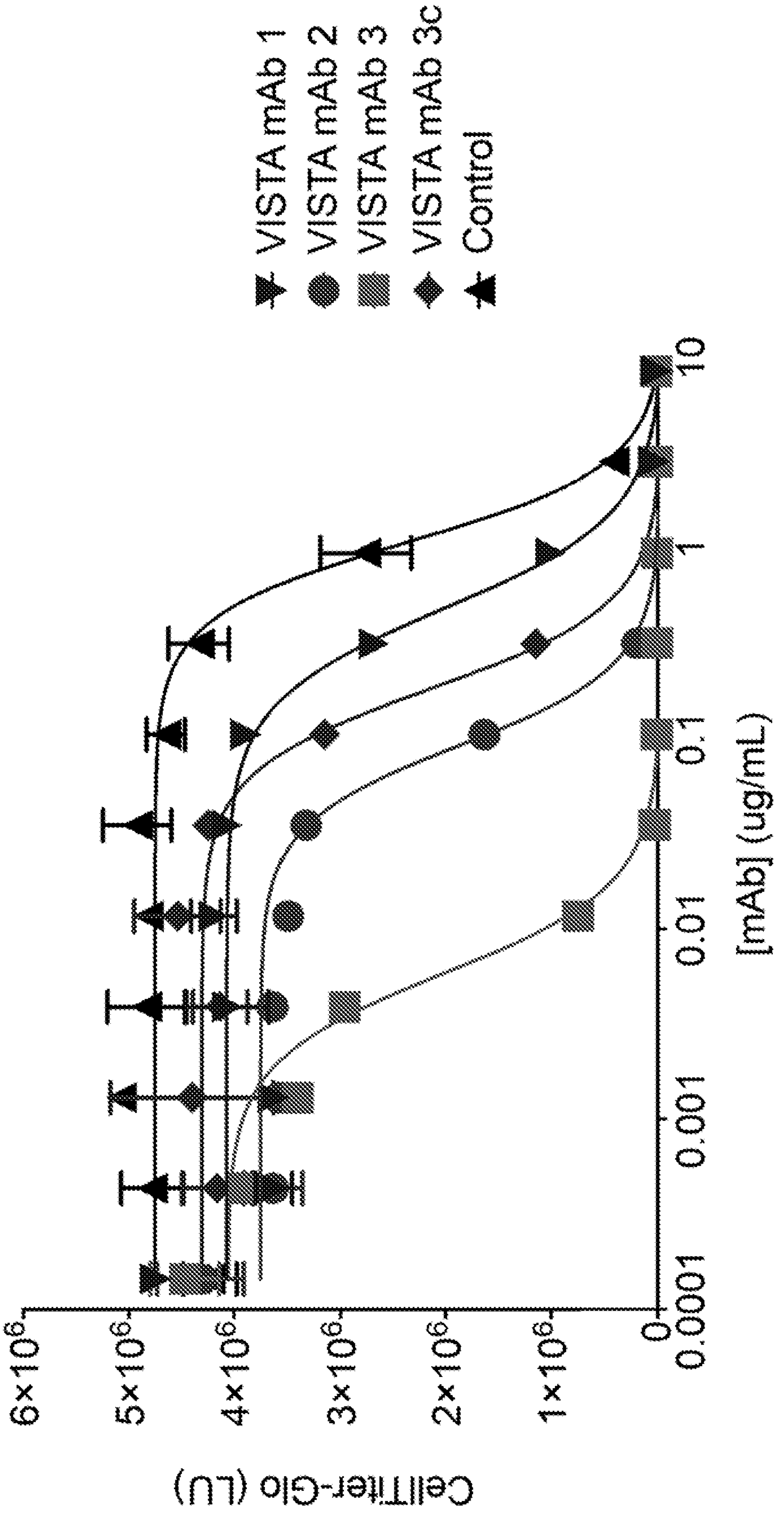

To confirm that binding at acidic pH was responsible for the differences in potency, VISTA antibody 3 was affinity optimized such that its ability to bind VISTA at acidic pH was improved. FIG. 6E shows an SPR assay comparing the hVISTA antibody binding profiles of VISTA antibody 3 with this variant, VISTA antibody 3c, using the assay conditions described for FIG. 6C. VISTA antibody 3 again exhibited VISTA binding impairment at acidic pH, whereas the variant VISTA antibody 3c exhibited comparable VISTA binding at acidic and physiological pH. FIG. 6F shows the activity of VISTA antibody 3c (diamonds) in the killing assay described for FIG. 6D. The acidic pH-optimized variant of VISTA antibody 3 exhibited a 31-fold lower potency than that of the original antibody, indicating that impaired anti-VISTA antibody binding at acidic pH results in a loss of antibody binding during VISTA recycling.

Figure 6G:
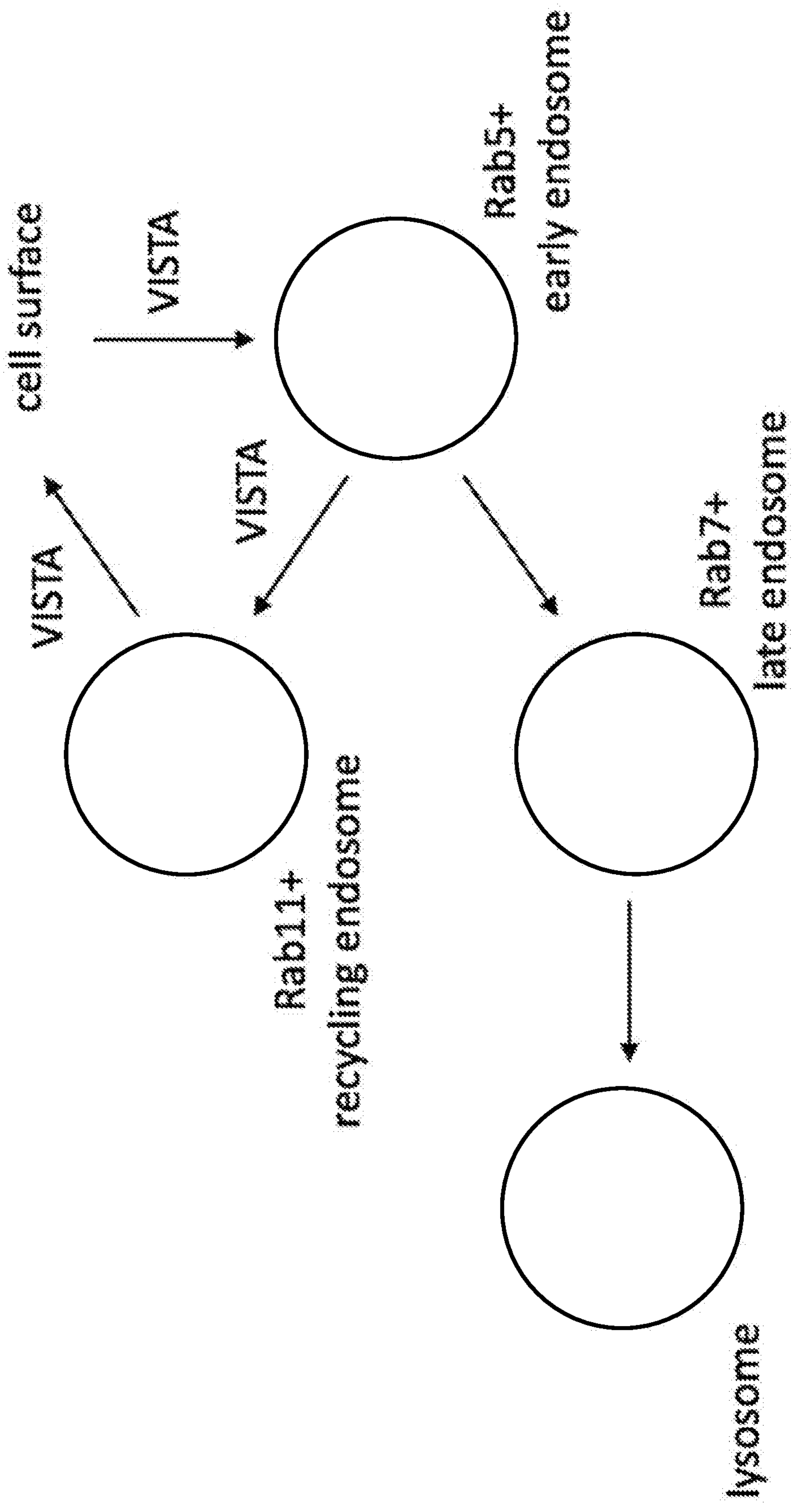

Based on these findings, a recycling model is proposed in which VISTA gets recycled to and from the cell surface via early endosomes and recycling endosomes. This model is depicted in FIG. 6G. Anti-VISTA antibodies can recycle with VISTA through these endosomes, maintaining target engagement. However, VISTA antibodies with impaired VISTA binding at acidic pH, particularly those with a fast off-rate at acidic pH, may disassociate from VISTA during recycling and become trapped or degraded inside cells, resulting in poor target engagement and continual consumption of circulating antibodies. In contrast, antibodies which bind and remain bound to VISTA at acidic pH may maintain higher levels of target engagement, particularly in acidic microenvironments such as tumors, and exhibit longer mean residence times in vivo.

Example 7: Superiority of VISTA Antibodies Lacking Binding at Physiological pH The inventors have shown that VISTA is an acidic pH-selective immunoreceptor, demonstrating the importance and utility of targeting VISTA with antibodies that bind well at acidic pH. Additionally, antibodies that do not bind or negligibly bind to VISTA at physiological pH are advantageous for several reasons. First, due to the relatively abundant expression of VISTA on circulating myelomonocytic cells, particularly monocytes and neutrophils, antibodies that bind VISTA at physiological pH are subject to high levels of target-mediated drug disposition (TMDD) in blood. This effect is exacerbated by the propensity of VISTA to recycle through intracellular endosomes, leading to anti-VISTA antibody internalization and degradation. This secondary effect is particularly problematic for antibodies which have impaired binding at acidic pH, as can be observed for antibodies that bind VISTA's histidine-rich ligand interface. Both effects will reduce the amount of anti-VISTA antibody in circulation, reducing the amount of antibody that will reach the tumor and thus the intended biology activity of the antibody. Second, antibodies that bind VISTA at physiological pH and which possess effector functions such as induction of antibody-dependent cell cytotoxicity (ADCC), antibody-dependent cell phagocytosis (ADCP), or delivery of an immunomodulatory payload will subject circulating myelomonocytic cells to those effector functions, potentially resulting in undesirable effects such as circulating neutrophil depletion or activation. Thus, the inventors discovered that antibodies binding to huVISTA at acidic pH, but negligibly at physiological pH, have the double advantage of (1) better exposure in relevant sites such as tumors and (2) reduced toxicities in the case of antibodies with effector functions such as ADCC, ADCP, or delivery of an immunomodulatory payload. Additionally, because VISTA itself is an acidic pH-selective immunoreceptor, blockade of VISTA's ligand interface at physiological pH is likely unnecessary to modulate VISTA receptor-ligand activity. Therefore, antibodies that bind to huVISTA at acidic pH, but not significantly at physiological pH were generated as described below.

Example 8: Isolation of Anti-VISTA Antibodies Binding Preferentially to Human VISTA at Acidic pH Over Physiological pH This Example describes the generation of antibodies that bind preferentially to human VISTA at low (acidic) pH relative to neutral or physiological pH.

A library of anti-VISTA antigen binding fragments of antibodies was constructed and screened as follows. Antibody libraries were created using genetic material isolated from HuMab mice immunized with full length human VISTA (hVISTA). These antibodies were formatted as scFv and were selected against full length hVISTA binding at low pH (pH 6.0) via mRNA display (Xu L et al. (2002) *Chemistry & Biology* 9:933; Roberts R W and J W Szostak (1997) *Proc. Natl. Acad. Sci. USA* 94:12297; Kurz et al. (2000) Nucleic Acids Res. 28(18): E83). Selection output was analyzed via next generation sequencing (NGS), and library members that demonstrated an enrichment to VISTA binding at low pH were identified, reformatted as IgG 1.3 (an effectorless IgG1 constant region consisting of an IgG1 Fc having amino acid mutations L234A, L235E, and G237A), and screened for binding to VISTA by SPR.

Surface plasmon resonance (SPR) analysis was performed to measure the association rates (defined as ka or $k_{on}$, 1/Ms units), dissociation rates (defined as kd or $k_{off}$, $s^{-1}$ units) and affinity constants (defined as $K_D$, M units) for VISTA Abs at acidic and physiological pHs using a Biacore® T200 instrument (GE Healthcare). Protein A (Fisher Scientific catalog #21181) was diluted to 20 μg/ml in 10 mM sodium acetate pH 4.5 and immobilized onto flow cells of a CM5 biosensor following the manufacturer's amine coupling protocol (GE Healthcare), targeting 6,000 RU immobilization density of Protein A per flow cell. SPR experiments were conducted at 37° C. using PBST (137 mM sodium chloride, 2.7 mM potassium chloride, 10 mM phosphate buffer, 0.05% Tween 20) running buffer at pH 7.4 and 6.0. Antibodies were diluted to 20 nM in PBST pH 7.4, and were captured across active biosensor flow cells at 5 μl/min for 50 seconds. A concentration series of 50-0.2 nM monovalent hVISTA-ECD (SEQ ID NO: 325) was prepared in pH 7.4 and 6.0 running buffers, and was injected over the captured antibodies at 40 μl/min to measure association and dissociation. Two 15 second injections of 10 mM glycine pH 1.5 were used to regenerate the Protein A capture surface between assay cycles. Rate constants ka ($k_{on}$) and ka ($k_{off}$) were derived from reference flow cell and 0 nM blank-subtracted sensorgrams, and were fit to a 1:1 binding model in Biacore® T200 Evaluation Software v.2.0. For each VISTA antibody, the ratio of $k_{off}$ at pH 6/$k_{off}$ at pH 7.4 was calculated to identify antibodies exhibiting slow off-rates at acidic pH and fast off-rates at physiological pH.

Six antibodies, reformatted as IgG1.3 antibodies, demonstrated near equivalent affinity at both pH 6 and pH 7.4. In particular, two antibodies had a slower off rate at pH 6.0 than at pH 7.4 (i.e., faster $k_{off}$ at pH 7.4 than pH 6.0). The variable regions of these two huVISTA antibodies are referred to as P1-061015 and P1-061029 and the antibodies comprising these variable regions and formatted as IgG1.3 antibodies are referred to as P1-061015.IgG1.3 and P1-061029.IgG1.3, respectively. The $k_{off}$ rates of P1-061015.IgG1.3 and P1-061029.IgG1.3 are provided in Table 1.

TABLE 1

$k_{off}$ of selected antibodies at pH 6.0 and pH 7.0

| Antibody name | pH 6 $k_{off}$ ($s^{-1}$) | pH 7 $k_{off}$ ($s^{-1}$) | pH 6/pH 7 $k_{off}$ |
|---|---|---|---|
| P1-061015.IgG1.3 | $1.4 \times 10^{-3}$ | $2.3 \times 10^{-3}$ | 0.6 |
| P1-061029.IgG1.3 | $4.8 \times 10^{-3}$ | $9.1 \times 10^{-3}$ | 0.5 |

The heavy and light chain CDR1, CDR2 and CDR3 sequences of P1-061015 and P1-061029 are provided in Table 2 below and are also shown in the Sequence Table following the Examples section of the disclosure.

TABLE 2

Amino acid sequences of huVISTA antibodies binding to huVISTA preferentially at pH 6.0 than pH 7.4

| P1 ID | VH-gene | VH CDR1 | VH CDR2 | VH CDR3 |
|---|---|---|---|---|
| P1-061015.IgG1.3 | 3-33 | GFTFSSYAMH (SEQ ID NO: 95 Residues 26-35) | IIWYDGSNKYYADSVKG (SEQ ID NO: 95 Residues 50-66) | DSGFYSSYYFDY (SEQ ID NO: 95 Residues 99-110) |
| P1-061029.IgG1.3 | 3-09 | GFTLDDYAMH (SEQ ID NO: 67 Residues 26-35) | GINWNSANIGYADSVKG (SEQ ID NO: 67 Residues 50-66) | VPGYSGGWIDAFDV (SEQ ID NO: 67 Residues 99-112) |
| | VL-gene | VL CDR1 | VL CDR2 | VL CDR3 |
| P1-061015.IgG1.3 | L6 | RASQSVSSSYLA (SEQ ID NO: 96 Residues 24-35) | DASNRAT (SEQ ID NO: 96 Residues 51-57) | QQYNSYPYT (SEQ ID NO: 96 Residues 90-98) |

TABLE 2-continued

| Amino acid sequences of huVISTA antibodies binding to huVISTA preferentially at pH 6.0 than pH 7.4 | | | | |
|---|---|---|---|---|
| P1-061029.IgG1.3 | A27 | RASQSVSSSYLA (SEQ ID NO: 68 Residues 24-35) | GASSRAT (SEQ ID NO: 68 Residues 51-57) | QQYGSSPFT (SEQ ID NO: 68 Residues 90-98) |

Example 9: Further Engineering of the P1-061015 and P1-061029 Anti-VISTA Abs to Develop Acidic pH-Selective Antibodies This Example describes the further engineering of variable regions P1-061015 and P1-061029 identified in Example 2 to obtain anti-huVISTA variable regions that have a higher $k_{off}$ ratio between binding at pH 6.0 relative to pH 7.4.

Figure 7A:
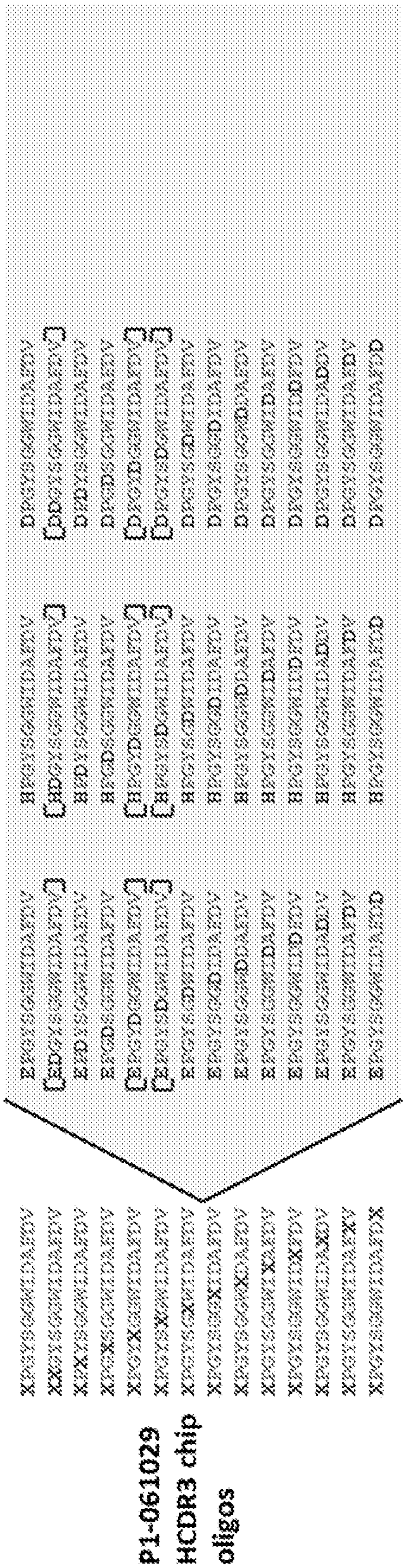
FIGS. 7A-F show how anti-VISTA antibody variant libraries were designed and screened in order to obtain acidic pH-selective antibodies.

Two libraries were built by introducing specific mutations in the VH CDRs of P1-061015 and P1-061029, respectively. The libraries allowed only for amino acid substitutions that were the most likely to improve binding at low pH, i.e., aspartate, glutamate and histidine. The library also allowed for single and double amino acid substitutions in each CDR and for recombinations across CDRs (maximum of 6 amino acid substitutions per chain). FIG. 7A shows the mutations that were introduced into the heavy chain CDR3 amino acid sequences of P1-061029 to form the P1-061029 library. The figure indicates that specific sequences were excluded to avoid introducing liabilities (e.g., DG).

Figure 7B:
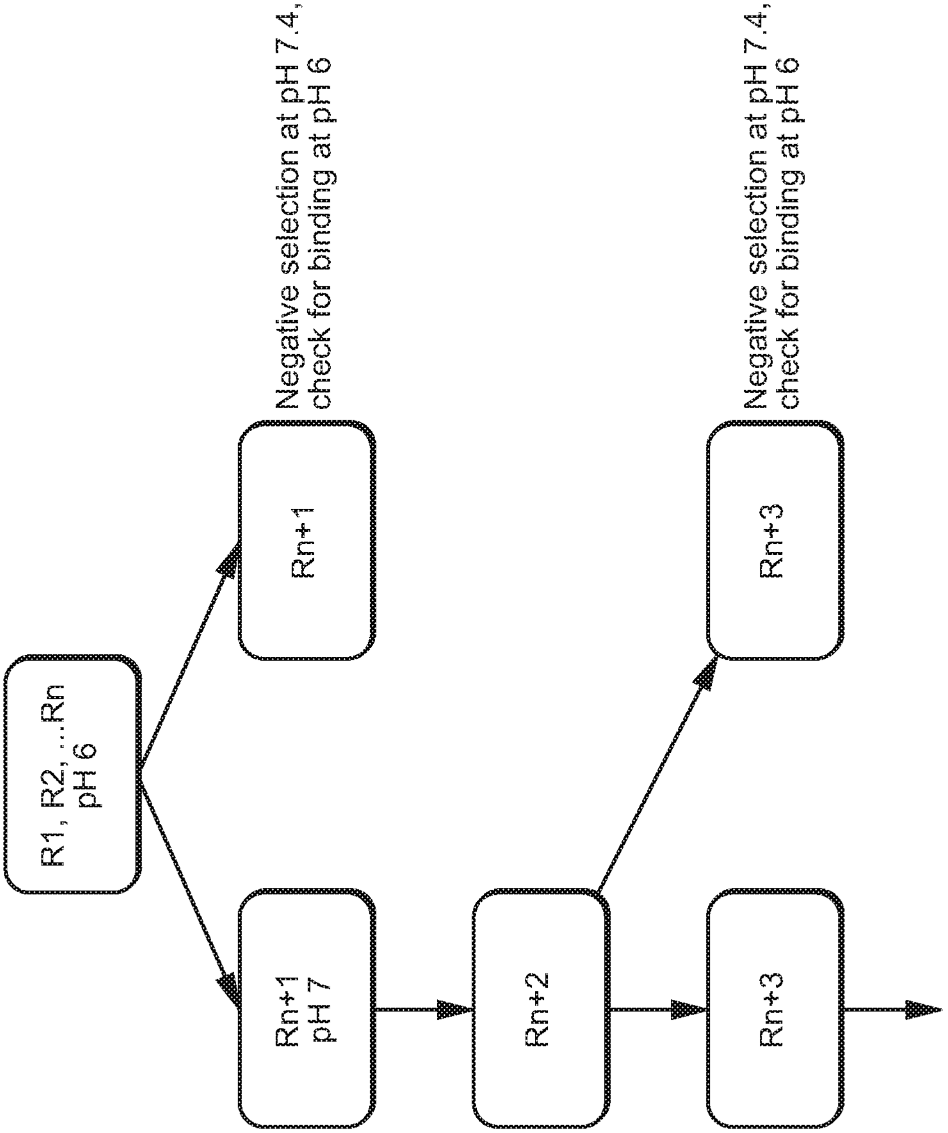
Figure 7C:
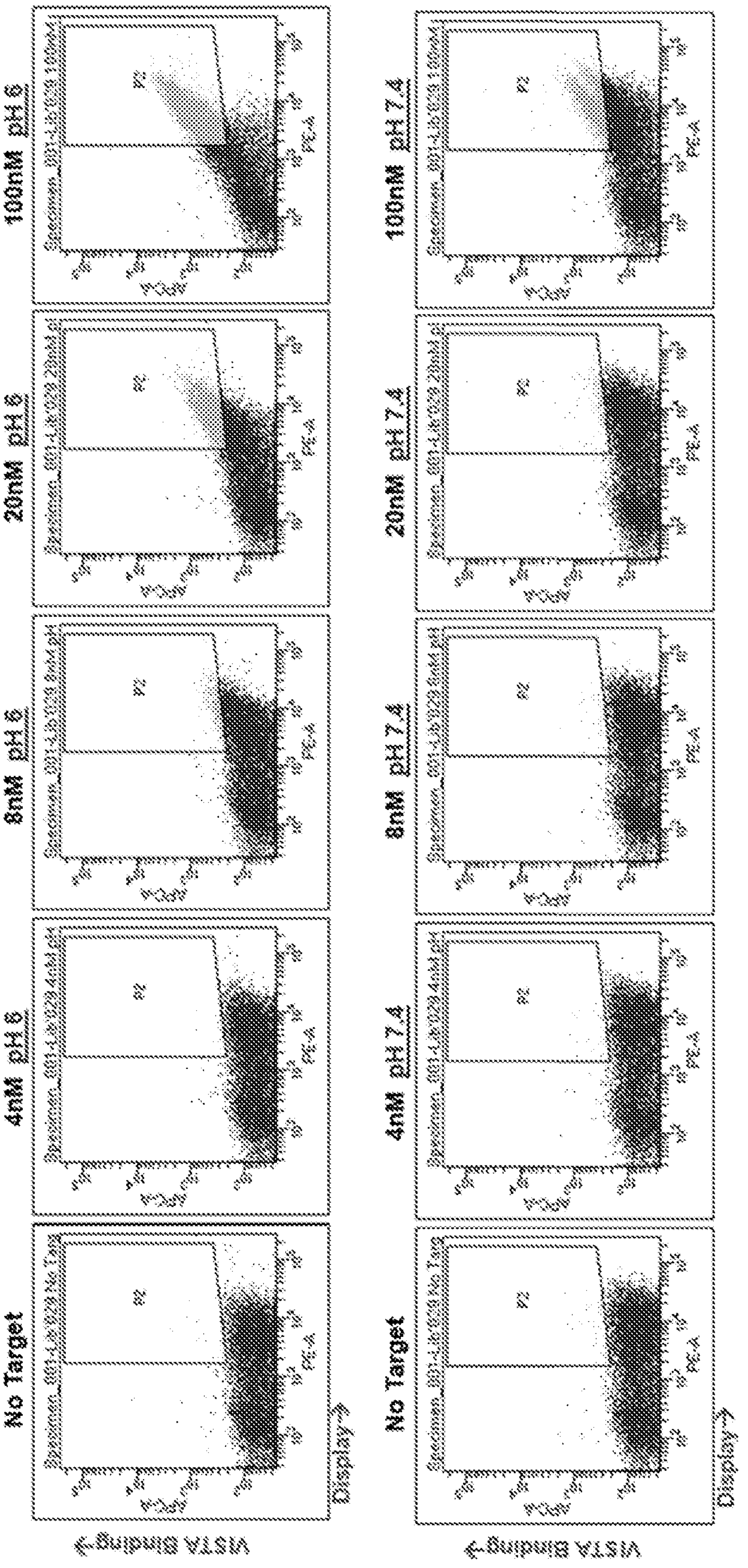

The ’029 and ’015 libraries were screened by several rounds of binding to full length hVISTA at pH 6.0 via yeast surface display. Further rounds of selection were conducted by toggling between positive (pH 6.0 binding to huVISTA) and negative (pH 7.4 binding to huVISTA) (shown in FIG. 7B) selections, where library members that did not bind to VISTA at pH 7.4 were collected in the negative selection rounds. The selection output was analyzed by NGS. The ’029 library members that bound to huVISTA at pH 6.0 after round 9 of selection were analyzed for binding to human VISTA at pH 6.0 and pH 7.4 via flow cytometry. FIG. 7C shows representative two-dimensional flow cytometry plots showing the variant pool after 9 rounds of selection. VISTA binding is plotted on the y-axis, and variant antibody expression is plotted on the x-axis. Binding data at various antibody concentrations and pH are shown. The results demonstrated very strong pH 6-selective binding to human VISTA, particularly at 20 nM.

Additional progeny clones of the ’029 were isolated from the ’029 library using a different method. Some clones were the same as those identified by the first method, and nine additional clones were isolated.

The 19 clones isolated from the ’029 library selected for further analysis were reformatted as IgG1.3 antibodies. The amino acid differences in the heavy chain CDRs of these clones relative to those of the ’029 VH CDRs are shown in Table 5.

TABLE 5

VH CDR1, CDR2 and CDR3 amino acid sequences (separated by an underscore) of antibodies derived from the ‘029 parent antibody

| NAME | CDR1 (pos 26-35) CDR2 (pos 50-66) CDR3 (pos 99-110) | SEQ ID NO |
|---|---|---|
| P1-061029 | GFT**LD**D**Y**AMH_GI**N**WNS**AN**IGYADSVKG_VPGYS**G**GWIDA**F**D**V** | 67 |
| P1-068757 | ----E-E---_------EE---------_-----------E-D | 71 |
| P1-068759 | ----E-E---_--D---E----------_-----------E-D | 87 |
| P1-068761 | ----E-E---_------EE---------_-----H-----E-- | 51 |
| P1-068763 | ----E-----_--D---E----------_-----H-----E-- | 91 |
| P1-068765 | ---DE-----_------EE---------_-----------E-D | 63 |
| P1-068767 | ----E-----_--D---E----------_-----------E-D | 55 |
| P1-068769 | ----E-E---_------DH---------_-----------E-D | 83 |
| P1-068771 | ----E-E---_------HE---------_-----------E-D | 75 |
| P1-068773 | ----E-----_--D---D----------_-----------E-D | 59 |
| P1-068775 | ----E-E---_--D---EE---------_-----H-----E-D | 79 |
| P1-069059 | ----E-----_------DH---------_-----------E-D | 11 |
| P1-069061 | ----E-----_-------E---------_-----------E-D | 15 |
| P1-069063 | ----E-----_-------E---------_-----------D-E | 19 |
| P1-069065 | ----E-E---_------DD---------_-------------- | 23 |
| P1-069067 | ----------_------EE---------_-----------D-E | 27 |

TABLE 5-continued

VH CDR1, CDR2 and CDR3 amino acid sequences (separated by an underscore) of antibodies derived from the '029 parent antibody

| NAME | CDR1 (pos 26-35) CDR2 (pos 50-66) CDR3 (pos 99-110) | SEQ ID NO |
|---|---|---|
| P1-069069 | ----------_------EE---------_-----------D-- | 31 |
| P1-069071 | ----E-E---_-------D---------_-----E-------- | 35 |
| P1-069073 | ----E-----_--D---D----------_-----------E-D | 39 |
| P1-069075 | ----E-----_----D--E---------_-----H-----E-- | 43 |
| P1-069077 | ----E-E---_------DE---------_-------------- | 47 |

Binding of several preparations of each of the '029 progeny clones and of the parent '029 antibodies, formatted as IgG1.3 antibodies, to human VISTA at pH 6.0 and 7.4 was measured by Surface plasmon resonance (SPR). SPR analysis was performed to measure koff and $K_D$ binding affinity measurements for VISTA Abs at acidic and neutral pHs using a Biacore® T100 instrument (GE Healthcare). Protein A (ThermoFisher Scientific catalog #21181) was diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. SPR experiments were conducted at 37° C. using PBST (137 mM sodium chloride, 2.7 mM potassium chloride, 10 mM phosphate buffer, 0.05% Tween® 20) running buffer at pH 7.4 and 6.0. Antibodies were diluted to 25 nM in PBST pH 7.4, and were captured across active biosensor flow cells at 5 μl/min for 60 seconds. A concentration series of 50-5 nM monovalent hVISTA-ECD (SEQ ID NO: 325) was prepared in pH 7.4 and 6.0 running buffers, and was injected over the captured antibodies at 40 μl/min to measure association and dissociation. Two 15 second injections of 10 mM glycine pH 1.5 were used to regenerate the Protein A capture surface between assay cycles. Rate constants ka ($k_{on}$) and kd ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody.

Figure 7D:
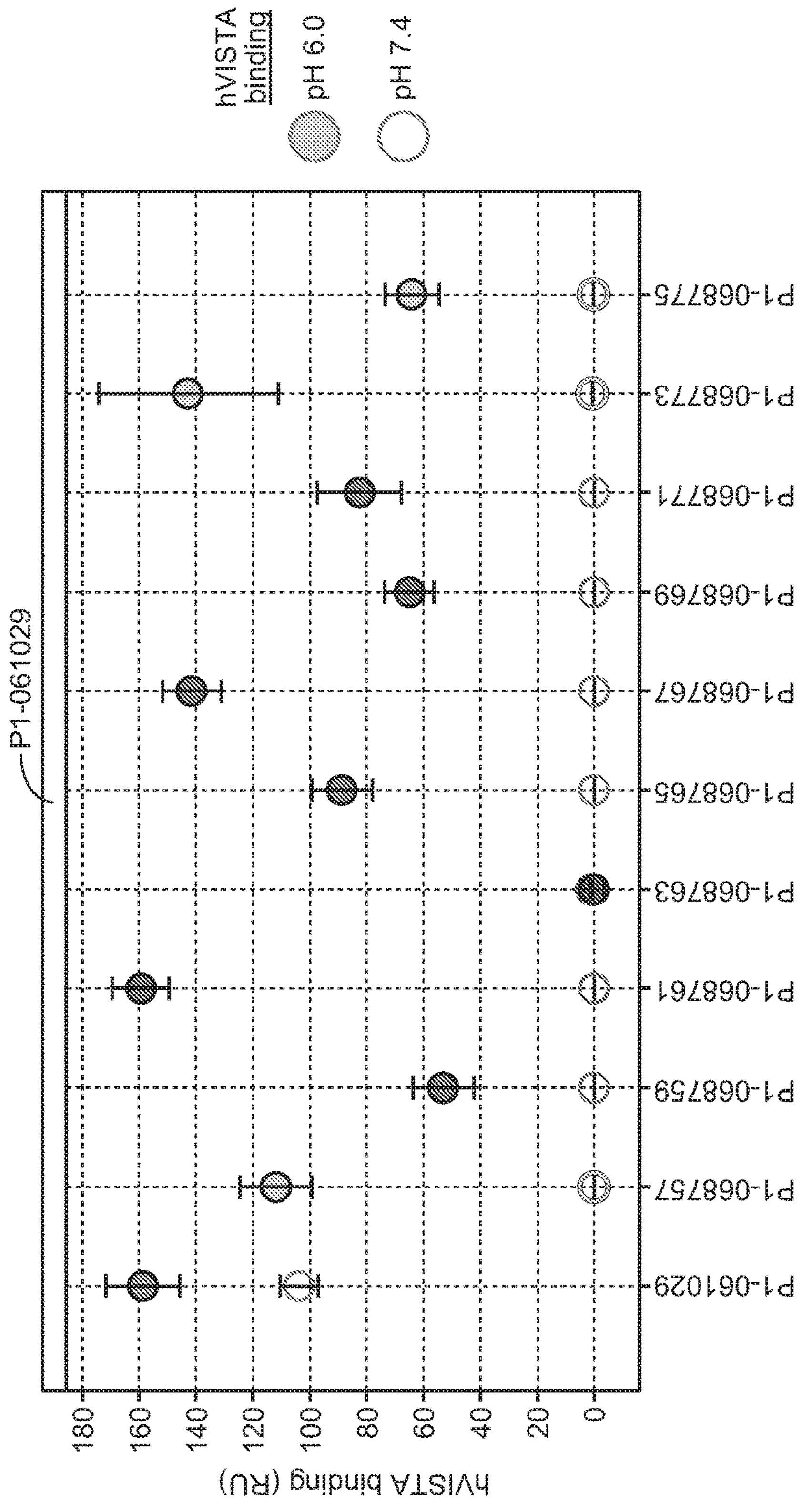

The maximal (or magnitude) human VISTA binding response is defined as the reference-subtracted 'binding' report point response at the end of the 50 nM VISTA injection for each antibody, and is reported in response units (RUS). The maximal human VISTA binding response (RUs) to each antibody is plotted in FIG. 7D. The mean average binding response (between two to four replicate antibodies) is plotted, and error bars represent the standard deviation. The results indicate that the selected progeny clones of '029 bind to hVISTA at pH 6.0, but not at pH 7.4 (empty circles representing binding at pH 7.4 are all located at the bottom of the graph except for the parent '029 clone).

Figure 7E:
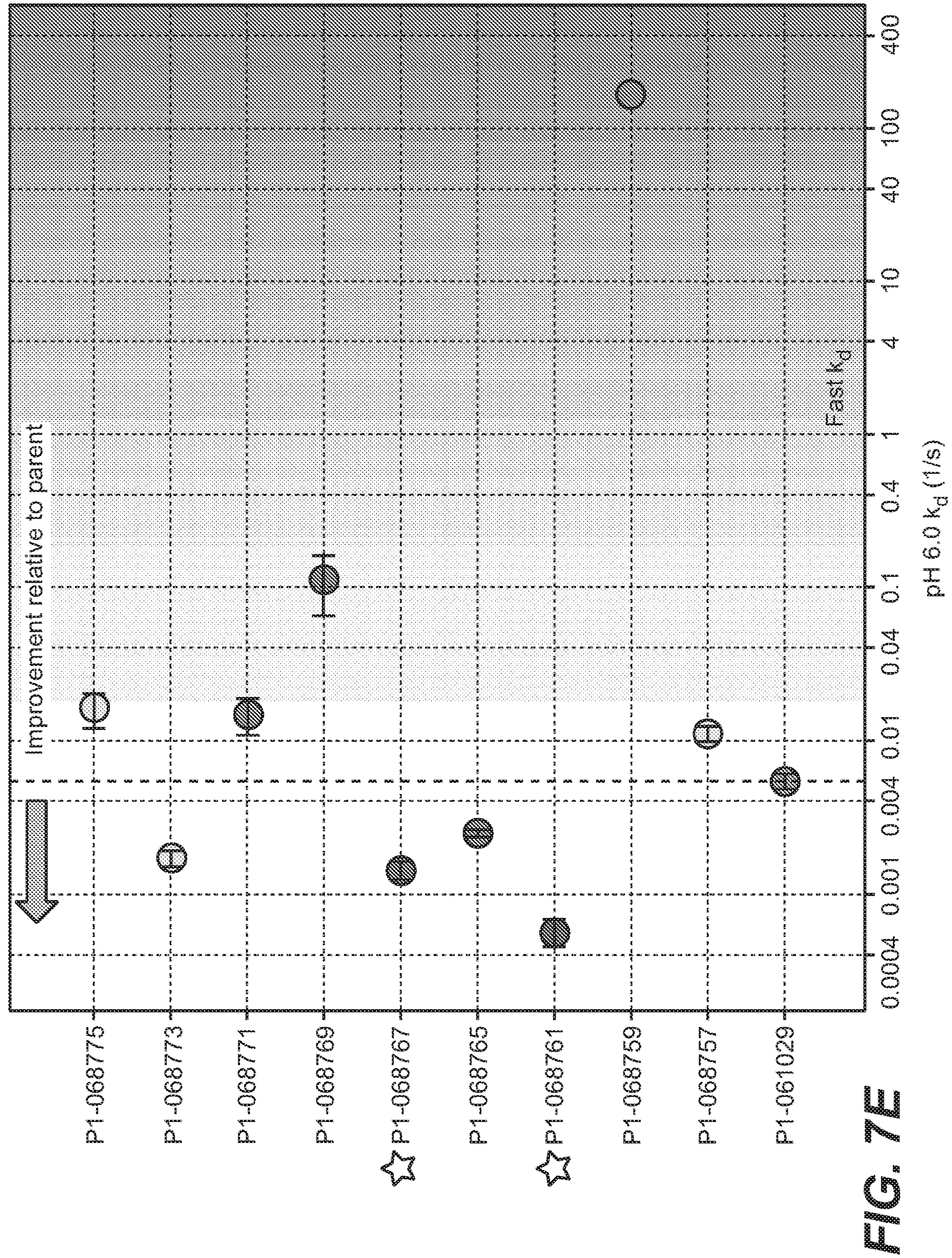

The $k_{off}$ rates at pH 6.0 of the '029 and its progeny was determined by SPR using the method described above, and are represented in FIG. 7E. The dashed line in the figure represent the $k_{off}$ rate of '029, and clones to the left of the dashed line have a slower $k_{off}$ rate at pH 6.0 relative to that of the parental '029 antibody, whereas those on the right side have a faster $k_{off}$ rate at pH 6.0 relative to that of the parental '029 antibody.

Figure 7F:
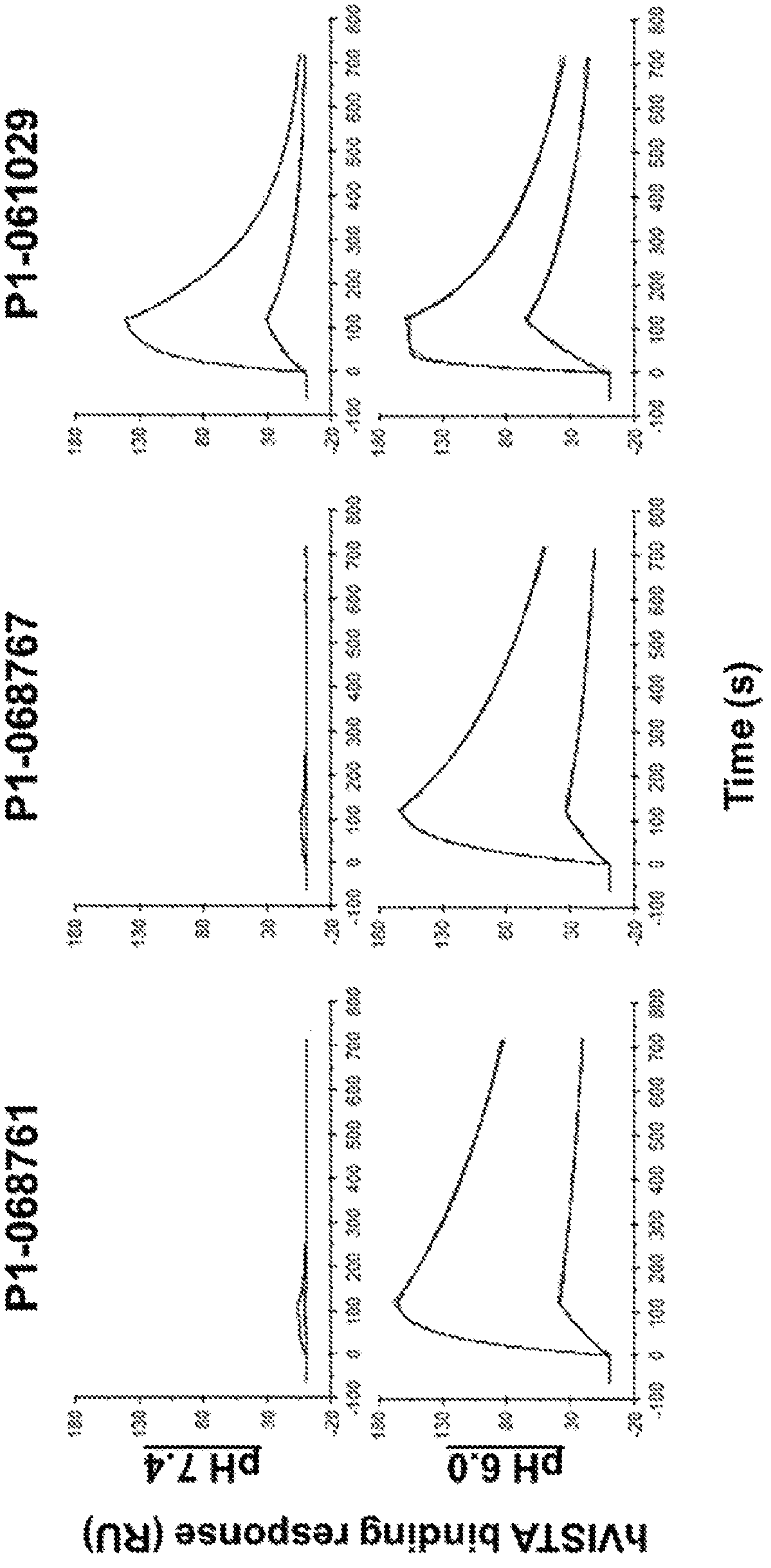

Representative hVISTA SPR binding sensorgrams to the '029, '761 and '767 antibodies at neutral and acidic pH are shown in FIG. 7F. Reference-subtracted 50 nM and 5 nM huVISTA sensorgrams are plotted. At neutral pH, <10 RU VISTA binding signal was observed for '761 and '767, thus in order to adequately measure and compare the $k_{off}$ and $K_D$ for '761 and '767 to '029, a SPR kinetics assay utilizing μM VISTA concentrations at physiological pH was required.

For this assay, '029, '761 and '767 were reformatted as hIgG1f isotype and were expressed as both standard hIgG1f and in hIgG1f afucosylated formats to compare against the hIgG1.3f Fc. An SPR kinetics assay was conducted to measure $k_{off}$ and $K_D$ binding affinity measurements for VISTA Abs at acidic and physiological pH using a Biacore® T100 instrument (GE Healthcare). Protein A (ThermoFisher Scientific catalog #21181) was diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. SPR experiments were conducted at 37° C. using PBST (137 mM sodium chloride, 2.7 mM potassium chloride, 10 mM phosphate buffer, 0.05% Tween 20) running buffer at pH 7.4 and 6.0. Antibodies were diluted to 25 nM in PBST pH 7.4, and were captured across active biosensor flow cells at 5 ul/min for 45 seconds. A concentration series of 1600-0.78 nM (pH 7.4) and 100-0.78 nM (pH 6.0) monovalent h VISTA-ECD (SEQ ID NO: 325) was prepared running buffer, and was injected over the captured antibodies at 40 μl/min to measure association and dissociation. Two 15 second injections of 10 mM glycine pH 1.5 were used to regenerate the Protein A capture surface between assay cycles. Rate constants ka ($k_{on}$) and kd ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody. Ratios of $k_{off}$ and $K_D$ at pH 7.4/pH 6.0 were calculated to compare off-rate and affinity improvement at acidic pH relative to physiological pH. While the neutral pH binding rate constants were not previously able to be determined for '761 and '767 using 50 nM hVISTA (FIGS. 7D and 7F), increasing the neutral pH VISTA concentration range to 1.6 M resulted in binding responses (>10 RU) for these clones that fit to a 1:1 binding model. Kinetic data for these acidic-selective VISTA antibodies is shown in Table 6. The '029 parent exhibits equivalent $k_{off}$ at both pHs, while '761 and '767 exhibit over 10-fold selectivity for pH 6 over pH 7.4 in $k_{off}$ and over 2000-fold selectivity for pH 6 over pH 7.4 in $K_D$. Human VISTA binding rate constants are conserved across hIgG1.3f, hIgG1f and afucosylated hIgG1f isotype variants.

TABLE 6

| Binding characteristics of VISTA antibodies as determined by SPR | | | | | | | | | |
|---|---|---|---|---|---|---|---|---|---|
| | | pH 7.4 | | | pH 6.0 | | | kd | KD |
| Antibody | Isotype | ka (1/Ms) | kd (1/s) | KD (M) | ka (1/Ms) | kd (1/s) | KD (M) | ratio (7.4/6) | ratio (7.4/6) |
| P1-061029 | hIgG1.3f | 1.6E+05 | 6.8E−03 | 4.2E−08 | 1.1E+06 | 7.9E−03 | 7.2E−09 | 0.9 | 5.8 |
| | hIgG1f | 1.7E+05 | 7.4E−03 | 4.2E−08 | 1.1E+06 | 8.0E−03 | 7.1E−09 | 0.9 | 5.9 |
| | hIgG1f afucosylated | 1.7E+05 | 7.2E−03 | 4.1E−08 | 1.1E+06 | 7.8E−03 | 6.9E−09 | 0.9 | 5.9 |
| P1-068761 | hIgG1.3f | 3.8E+03 | 4.2E−02 | 1.1E−05 | 3.7E+05 | 1.6E−03 | 4.3E−09 | 26.3 | 2558.1 |
| | hIgG1f | 1.2E+03 | 4.2E−02 | 3.5E−05 | 3.6E+05 | 1.5E−03 | 4.2E−09 | 28.0 | 8333.3 |
| | hIgG1f afucosylated | 5.1E+03 | 4.2E−02 | 8.2E−06 | 3.7E+05 | 1.5E−03 | 4.1E−09 | 28.0 | 2000.0 |
| P1-068767 | hIgG1.3f | 1.9E+03 | 3.6E−02 | 1.9E−05 | 3.3E+05 | 2.6E−03 | 7.8E−09 | 13.8 | 2435.9 |
| | hIgG1f | 1.5E+03 | 3.2E−02 | 2.2E−05 | 3.2E+05 | 2.6E−03 | 8.0E−09 | 12.3 | 2750.0 |
| | hIgG1f afucosylated | 1.3E+03 | 3.3E−02 | 2.4E−05 | 3.3E+05 | 2.6E−03 | 7.9E−09 | 12.7 | 3038.0 |
| α-VISTA acidic pH sensitive | hIgG1.3f | 2.2E+05 | 7.8E−04 | 3.6E−09 | 2.8E+06 | 9.0E−02 | 3.2E−08 | 0.01 | 0.1 |

Human VISTA binding kinetics of P1-061029 ("'029"), P1-068761 ("'761") and P1-068767 ("'767") (as IgG1.3 antibodies) were measured at pH values between pH 7.4 and pH 6.0, i.e., at pH 6.9 and pH 6.45 using a Biacore® T100 instrument (GE Healthcare). Protein A (ThermoFisher Scientific catalog #21181) was diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay was conducted at 37° C. using PBST (137 mM sodium chloride, 2.7 mM potassium chloride, 10 mM phosphate buffer, 0.05% Tween 20) running buffer at pH 7.4, 6.9, 6.45 and 6.0. Antibodies were diluted to 25 nM in PBST pH 7.4, and were captured across active biosensor flow cells at 5 μl/min for 45 seconds. A concentration series of 100-0.78 nM monovalent hVISTA-ECD (SEQ ID NO: 325) was prepared pH 7.4, 6.9, 6.45 and 6.0 running buffers, and was injected over the captured antibodies at 40 μl/min to measure association and dissociation. Two 15 second injections of mM glycine pH 1.5 were used to regenerate the Protein A capture surface between assay cycles. Rate constants ka ($k_{on}$) and kd ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody. Ratios of $k_{off}$ and $K_D$ at each pH relative to pH 6.0 were calculated to evaluate how the VISTA $k_{off}$ and $K_D$ change as the buffer pH shifts to physiological, and are shown in Table 7. The '029 parent exhibited consistent $k_{off}$ at each pH tested, while the '761 and '767 progeny exhibited at least 10-fold faster VISTA $k_{off}$ and 100-fold weaker VISTA $K_D$ at pH 6.9 compared to pH 6.0. As the buffer pH shifts from acidic to physiological, VISTA $k_{off}$ and $K_D$ both weaken for '761 and '767. Physiological pH data for '761 and '767 for comparison is referenced from Table 7 and noted with an asterisk (*).

TABLE 7

| Kinetic binding characteristics of '029, '761 and '767 antibodies at different pH values | | | | | | |
|---|---|---|---|---|---|---|
| Antibody | pH | ka (1/Ms) | kd (1/s) | KD (M) | koff ratio to pH 6.0 | KD ratio to pH 6.0 |
| P1-061029 | 6.0 | 2.9E+06 | 5.7E−03 | 2.0E−09 | 1.0 | 1.0 |
| (parent) | 6.45 | 7.4E+05 | 4.0E−03 | 5.3E−09 | 0.7 | 2.7 |
| | 6.9 | 4.1E+05 | 5.7E−03 | 1.4E−08 | 1.0 | 7.1 |
| | 7.4 | 2.5E+05 | 6.4E−03 | 2.6E−08 | 1.1 | 13.2 |
| P1-068761 | 6.0 | 6.0E+05 | 6.6E−04 | 1.1E−09 | 1.0 | 1.0 |
| | 6.45 | 1.1E+05 | 2.1E−03 | 2.0E−08 | 3.2 | 18.4 |
| | 6.9 | 4.8E+04 | 8.9E−03 | 1.9E−07 | 13.4 | 170 |
| | 7.4 * | 3.8E+03 | 4.2E−02 | 1.1E−05 | ~63.6 | ~10000 |
| P1-068768 | 6.0 | 5.6E+05 | 1.9E−03 | 3.4E−09 | 1.0 | 1.0 |
| | 6.45 | 1.3E+05 | 4.8E−03 | 3.8E−08 | 2.5 | 11.0 |
| | 6.9 | 7.4E+04 | 2.9E−02 | 4.0E−07 | 15.3 | 115.1 |
| | 7.4 * | 1.9E+03 | 3.6E−02 | 1.9E−05 | ~19.0 | ~5000 |

The data in Table 7 indicates that an at least 10 fold lower affinity of binding of '761 and '767 to hVISTA at pH 6.45 compared to pH 6.0; an at least 100 fold lower affinity of binding of '761 and '767 to h VISTA at pH 6.9 compared to pH 6.0; and an at least 1000 fold lower affinity of binding of '761 and '767 to h VISTA at pH 7.4 compared to pH 6.0.

The '015 library also demonstrated a slight preference for pH 6-selective binding to VISTA. The amino acid differences of the progeny clones relative to the '015 VH CDRs is shown in Table 8. Binding of several preparations of each of the '015 progeny clones and of the parent '015 (all as IgG1.3 antibodies) to human VISTA at pH 6.0 and 7.4 was measured via SPR using the identical method described for the '029 analysis above, and is shown in Table 8.

TABLE 8

VH CDR1, CDR2 and CDR3 amino acid sequences of antibodies (separated by underscore) derived from the '015 parent antibody

| NAME | CDR1 (pos 26-35) CDR2 (pos 50-66) CDR3 (pos 99-110) | SEQ ID NO |
| --- | --- | --- |
| P1-061015 | GFTES**S**YA**M**H_IIW**Y**DGS**NKYY**ADSVKG_DSGFY**SS**YYEDY | 95 |
| P1-068736 | -----E----_-D-------D-------_-----D-----D | 107 |
| P1-068738 | -----E--H-_---D----H--------_-----ED----- | 131 |
| P1-068740 | -----D----_-------D-D-------_-----D-----D | 115 |
| P1-068742 | -----D----_-------D-D-------_-----ED----- | 119 |
| P1-068744 | -----E----_H---------E------_-----E-----E | 103 |
| P1-068746 | ----------_--------HH-------_-----D------ | 123 |
| P1-068748 | -----HH---_--------DD-------_-----D------ | 99 |
| P1-068750 | -----D-D--_E--D-------------_-EE--------- | 127 |
| P1-068752 | ----------_E--------D-------_-----D-----E | 111 |
| P1-068754 | -----D-D--_E--D-------------_----H-D----- | 135 |

A summary of the kinetics of binding of '029 and '015 and their progeny clones to huVISTA at pH 6.0 and 7.4, as determined by SPR, is shown in Tables 9 and 10.

TABLE 9 huVISTA kinetics summary and VH CDR sequences of the '029 clone and their progeny

| ID | Avg 7.4 ka (1/Ms) | Avg 7.4 kd (1/s) | Avg 7.4 KD (M) | Avg 6.0 ka (1/Ms) | Avg 6.0 kd (1/s) | Avg 6.0 KD (M) | VH CDR 1 (pos 26-35) | VH CDR 2 (pos 50-66) | VH CDR 3 (pos 99-110) | SEQ ID NO |
| --- | --- | --- | --- | --- | --- | --- | --- | --- | --- | --- |
| P1-069077 | 6.0E+04 | 1.9E-03 | 3.1E-08 | 6.3E+05 | 1.2E-04 | 1.9E-10 | ....E.E... | ......DE......... | .............. | 47 |
| P1-069065 | 5.9E+04 | 2.3E-03 | 3.9E-08 | 5.7E+05 | 2.2E-04 | 3.8E-10 | ....E.E... | ......DD......... | .............. | 23 |
| P1-069075 | 1.3E+05 | 2.3E-03 | 1.8E-08 | 1.3E+06 | 2.9E-04 | 2.2E-10 | ....E..... | ....D..E......... | .....H.....E.. | 43 |
| P1-069071 | 4.3E+04 | 4.0E-03 | 9.3E-08 | 7.0E+05 | 5.1E-04 | 7.3E-10 | ....E.E... | .......D......... | .....E........ | 35 |
| P1-069061 | Weak, fast kd | | | 4.3E+05 | 1.1E-03 | 2.5E-09 | ....E..... | .......E......... | ...........E.D | 15 |
| P1-069069 | 9.0E+04 | 7.5E-03 | 8.4E-08 | 1.4E+06 | 1.2E-03 | 8.6E-10 | .......... | ......EE......... | ...........D.. | 31 |
| P1-068761 | Weak, fast kd | | | 3.8E+05 | 1.4E-03 | 3.8E-09 | ....E.E... | ......EE......... | .....H.....E.. | 51 |
| P1-069059 | Weak, fast kd | | | 3.4E+05 | 1.6E-03 | 4.8E-09 | ....E..... | ......DH......... | ...........E.D | 11 |
| P1-068767 | Weak, fast kd | | | 3.4E+05 | 2.6E-03 | 7.6E-09 | ....E..... | ..D...E.......... | ...........E.D | 55 |
| P1-068773 | Weak, fast kd | | | 3.0E+05 | 2.9E-03 | 9.4E-09 | ....E..... | ..D...D.......... | ...........E.D | 59 |
| P1-069063 | 1.2E+05 | 2.7E-02 | 2.3E-07 | 1.9E+06 | 4.4E-03 | 2.4E-09 | ....E..... | .......E......... | ...........D.E | 19 |
| P1-069067 | 1.0E+05 | 2.7E-02 | 2.9E-07 | 1.7E+06 | 4.5E-03 | 2.7E-09 | .......... | ......EE......... | ...........D.E | 27 |

TABLE 9-continued huVISTA kinetics summary and VH CDR sequences of the '029 clone and their progeny

| ID | Avg 7.4 ka (1/Ms) | Avg 7.4 kd (1/s) | Avg 7.4 KD (M) | Avg 6.0 ka (1/Ms) | Avg 6.0 kd (1/s) | Avg 6.0 KD (M) | VH CDR 1 (pos 26-35) | VH CDR 2 (pos 50-66) | VH CDR 3 (pos 99-110) | SEQ ID NO |
|---|---|---|---|---|---|---|---|---|---|---|
| P1-069073 | Weak, fast kd | | | 6.1E+05 | 5.8E-03 | 9.4E-09 | ....E.E... | .......E......... | ...........E.. | 39 |
| P1-061029 | 2.9E+05 | 5.6E-03 | 1.9E-08 | 1.6E+06 | 5.8E-03 | 3.6E-09 | GFTLDDYAMH | GINWNSANIGYADSVKG | VPGYAGGWIDAFDV | 67 |
| P1-068765 | No binding | | | 3.7E+05 | 7.0E-03 | 1.9E-08 | ...DE..... | ......EE......... | ...........E.D | 63 |
| P1-068757 | No binding | | | 8.9E+05 | 1.7E-02 | 1.9E-08 | ....E.E... | ......EE......... | ...........E.D | 71 |
| P1-068771 | No binding | | | 7.6E+05 | 1.8E-02 | 2.5E-08 | ....E.E... | ......HE......... | ...........E.D | 75 |
| P1-068769 | No binding | | | 8.1E+05 | 4.0E-02 | 5.5E-08 | ....E.E... | ......DH......... | ...........E.D | 83 |
| P1-068775 | No binding | | | 1.8E+06 | 4.7E-02 | 2.3E-08 | ....E.E... | ..D...EE......... | .....H.....E.D | 79 |
| P1-068759 | No binding | | | 1.3E+06 | 8.0E-02 | 6.0E-08 | ....E.E... | ..D...E.......... | ...........E.D | 87 |

TABLE 10 huVISTA kinetics summary and VH CDR sequences of the '015 clone and their progeny

| Clone | Avg 7.4 ka (1/Ms) | Avg 7.4 kd (1/s) | Avg 7.4 KD (M) | Avg 6.0 ka (1/Ms) | Avg 6.0 kd (1/s) | Avg 6.0 KD (M) | HCDR Sequence (pos 26-35) (pos 50-66) (pos 99-110) | SEQ ID NO |
|---|---|---|---|---|---|---|---|---|
| P1-061015 | 2.3E+05 | 2.0E-03 | 8.8E-09 | 1.8E+06 | 9.5E-04 | 5.4E-10 | GFTFSSYAMH_IIWYDGSNKYYADSVKG_DSGFYSSYYFDY | 95 |
| P1-068748 | No binding | | | 1.4E+06 | 1.5E-03 | 1.0E-09 | .....HH..._........DD......._.....D...... | 99 |
| P1-068744 | | | | 1.3E+06 | 1.8E-03 | 1.3E-09 | .....E...._H.........E......_.....E.....E | 103 |
| P1-068736 | | | | 8.4E+06 | 9.5E-03 | 1.1E-09 | .....E...._.D.......D......._.....D.....D | 107 |
| P1-068752 | | | | 6.1E+06 | 3.4E-02 | 5.6E-09 | .........._E........D......._.....D.....E | 111 |
| P1-068740 | | | | Too fast | 4.7E-02 | ND | .....D...._.......D.D......._.....D.....D | 115 |
| P1-068742 | | | | Too fast | >1E-02 | ND | .....D...._.......D.D......._.....ED..... | 119 |
| P1-068746 | | | | Too fast | >1E-02 | ND | .........._........HH......._.....D...... | 123 |
| P1-068750 | | | | Weak | | | .....D.D.._E..D............._.EE......... | 127 |

Thus, several '029 progeny clones were identified which either maintained or improved $k_{off}$ to VISTA-ECD at pH 6.0 compared to the '029 parent, and also demonstrated weaker $k_{off}$ or a loss of binding to VISTA at physiologic pH. The '015 progeny exhibited acidic pH selective binding to VISTA-ECD, with no binding detected to VISTA at neutral pH, but all '015 progeny assayed yielded a faster $k_{off}$ at pH 6.0 compared to the '015 parent.

Example 10: Further Engineering of P1-061015 Progeny P1-068744 and P1-068748 Heavy Chains In order to further test the pH selectivity of the '015 progeny P1-068744 and P1-068748, particular amino acids within the heavy chain CDRs of each of the '744 and '748 antibodies are selectively reverted back to the parental P1-061015 amino acid residue. The tables below show the details of each of the '744 and '748 progeny and how their CDRs vary from those of their parental antibodies.

The P1-068744 heavy chain compares to that of its parental antibody P1-061015 (compare SEQ ID Nos: 95 and 103), as show in Table 11 below, in that P1-068744 contains several basic residues at particular locations in the heavy chain CDRs. These are an E residue at position 31 in CDR1, an H residue at position 50 in CDR2, an E at position 60 of CDR2 (a reversion of this change is called herein E59Y-see the table below), an E at position 104 in CDR3 (a reversion of this change is called herein E100S-see the table below), and an E at position 110 of CDR3 (the final position of CDR3) (a reversion of this change is called herein E102Y).

The P1-068748 heavy chain compares to that of antibody P1-061015, as shown in Table 12 below (and compare SEQ ID Nos. 95 and 99), in that it also contains several basic residues in the heavy chain CDRs. Specifically, H residues at positions 31 and 32 of CDR1, D residues at positions 58 and 59 of CDR2 (revertants are called D57K and D58Y herein, however), and a D residue at position 104 of CDR3 (revertants of this change are called D100S herein).

TABLE 11

Heavy chain amino acid sequence of progeny of P1-068744 compared to the P1-061015 and P1-068744 heavy chain amino acid sequences (top two rows). HC CDR sequences are underlined.

```
P1-061015_HC (SEQ ID NO: 95)
QVQLVESGGGVVQPGRSLRLSCAASGFTFSSYAMHWVRQAPGKGLEWVAIIWYDGSNKYYA
DSVKGRFTISRDNSKNTLYLQMNSLRAEDTAVYYCARDSGFYSSYYFDYWGQGTLVTVSS

P1-068744: '015 HC: S31E_I50H_
..............................E..................H.........E.
..........................................E.....E...........

P1-068744 VH: E31S
.................................................H.........E.
..........................................E.....E...........

P1-068744 VH: H50I
..............................E............................E.
..........................................E.....E...........

P1-068744 VH: E59Y
..............................E..................H...........
..........................................E.....E...........

P1-068744 VH: E100S
..............................E..................H.........E.
................................................E...........

P1-068744 VH: E102Y
..............................E..................H.........E.
..........................................E.................

P1-068744 VH: E31S H50I
...........................................................E.
..........................................E.....E...........

P1-068744 VH: H50I E59Y
..............................E..............................
..........................................E.....E...........

P1-068744 VH: E59Y E100S
..............................E..................H...........
................................................E...........

P1-068744 VH: E100S E102Y
..............................E..................H.........E.
............................................................

P1-068744 VH: E31S E102Y
.................................................H.........E.
..........................................E.................

P1-068744 VH: E31S E59Y
.................................................H...........
..........................................E.....E...........

P1-068744 VH: E31S E100S
.................................................H.........E.
................................................E...........

P1-068744 VH: H50I E100S
..............................E............................E.
................................................E...........
```

TABLE 11-continued

Heavy chain amino acid sequence of progeny of P1-068744 compared to the P1-061015 and P1-068744 heavy chain amino acid sequences (top two rows). HC CDR sequences are underlined.

P1-068744 VH: H50I E102Y
..............................E............................E.
..........................................E.................

P1-068744 VH: E59Y E102Y
..............................E..................H...........
..........................................E.................

TABLE 12

Heavy chain amino acid sequence of progeny of P1-068744 compared to the P1-061015 and P1-068744 heavy chain amino acid sequences (top two rows). HC CDR sequences are underlined.

P1-061015_HC (SEQ ID NO: 95)
QVQLVESGGGVVQPGRSLRLSCAASGFTFSSYAMHWVRQAPGKGLEWVAIIWYDGSNKYYA
DSVKGRFTISRDNSKNTLYLQMNSLRAEDTAVYYCARDSGFYSSYYFDYWGQGTLVTVSS

P1-068748: '015 HC: S31E_I50H_
..............................HH.........................DD..
..........................................D.................

P1-068748 VH: H31S
...............................H.........................DD..
..........................................D.................

P1-068748 VH: H32Y
..............................H..........................DD..
..........................................D.................

P1-068748 VH: D57K
..............................HH..........................D..
..........................................D.................

P1-068748 VH: D58Y
..............................HH.........................D...
..........................................D.................

P1-068748 VH: D100S
..............................HH.........................DD..
............................................................

P1-068748 VH: H31S H32Y
.........................................................DD..
..........................................D.................

P1-068748 VH: H32Y D57K
..............................H...........................D..
..........................................D.................

P1-068748 VH: D57K D58Y
..............................HH.............................
..........................................D.................

P1-068748 VH: D58Y D100S
..............................HH.........................D...
............................................................

P1-068748 VH: H31S D57K
...............................H..........................D..
..........................................D.................

P1-068748 VH: H31S D58Y
...............................H.........................D...
..........................................D.................

P1-068748 VH: H31S D100S
...............................H.........................DD..
............................................................

P1-068748 VH: H32Y D58Y
..............................H..........................D...
..........................................D.................

TABLE 12-continued

| Heavy chain amino acid sequence of progeny of P1-068744 compared to the P1-061015 and P1-068744 heavy chain amino acid sequences (top two rows). HC CDR sequences are underlined. |
| --- |
| P1-068748 VH: H32Y D100S<br>..............................H..........................DD..<br>............................................................ |
| P1-068748 VH: D57K D100S<br>..............................HH..........................D..<br>............................................................ |

The resulting revertant antibodies may be tested in various ways. Binding kinetics, for example, are measured using a Biacore® T100 instrument (GE Healthcare) according to the following protocol. Protein A (ThermoFisher Scientific catalog #21181) is diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay is conducted at 37° C. using PBST (137 mM sodium chloride, 2.7 mM potassium chloride, 10 mM phosphate buffer, 0.05% Tween 20) running buffer at pH 7.4, 6.7 and 6.0. Antibodies are diluted to 25 nM in PBST pH 7.4, and are captured across active biosensor flow cells at 5 μl/min for 40 seconds. A concentration series of 100-10 nM monovalent hVISTA-ECD (SEQ ID NO: 325) is prepared in pH 7.4, 6.7 and 6.0 running buffers, and is injected over the captured antibodies at 40 μl/min to measure association and dissociation. Two 15 second injections of 10 mM glycine pH 1.5 are used to regenerate the Protein A capture surface between assay cycles. Rate constants ka (kon) and kd (koff) are derived from reference flow cell and 0 nM blank-subtracted sensorgrams, and are fit to a 1:1 binding model in Biacore® T200 Evaluation Software v.2.0.

The affinity constant, $K_D$ is calculated as the ratio of rate constants $k_{off}/k_{on}$ for each VISTA antibody. The % Rmax is calculated to compare how pH affects an antibody's binding capacity for VISTA, and represents the measured maximal VISTA binding response relative to the expected maximal VISTA binding response. The % Rmax is defined as the ratio of the reference-subtracted 'binding' report point response at the end of the 100 nM VISTA injection for each antibody (Rmax) relative to the expected VISTA binding response (Rexp). Rexp is calculated as Rexp=[(VISTA-ECD molecular weight/mAb molecular weight)×(mAb 'capture' report point response (RUs)]×2 binding sites per mAb.

Example 11: PH-Dependent Binding of VISTA Antibody Clones to Human VISTA pH-dependent binding of antibody clones to Raji cells engineered to ectopically express full length human VISTA (SEQ ID NO: 1 with D187E substitution) can be measured. Binding can be measured, for example, at pHs from 6.0 to 8.1, such as a pHs 6.0, 6.1, 6.2, 6.3, 6.4, 6.6, 7.0, 7.2, 7.4, 8.0, and/or 8.1.

Figure 8B:
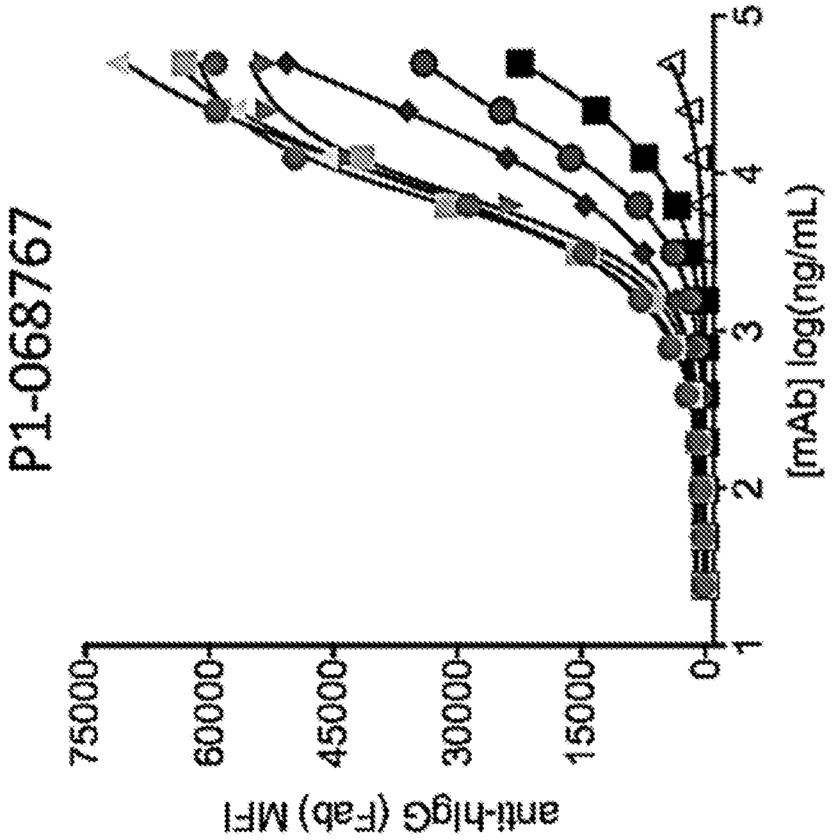
FIGS. 8A-F show acidic pH-selective cell binding, blocking, and effector activity of the VISTA antibodies P1-068761 and P1-068767.
Figure 8A:
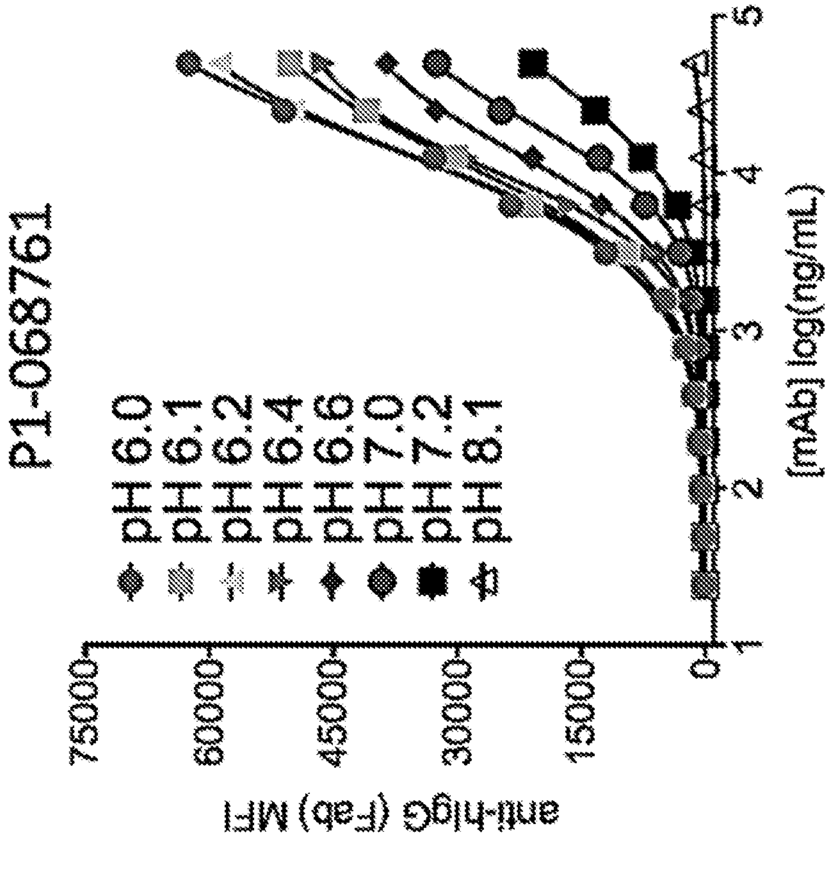

For example, pH-dependent binding of clones '761 and '767 to Raji cells engineered to ectopically express full length human VISTA (SEQ ID NO: 1 with D187E substitution) was previously measured. For this experiment, '761 and '767 were formatted as IgG1.3 antibodies, and binding was measured by an anti-human IgG secondary antibody (Jackson Immunoresearch catalog number 109-065-098). The results, which are shown in FIGS. 8A-8B, indicate that the '761 (FIG. 8A) and '767 clones (FIG. 8B) bind poorly at pH 7.2 and 8.1, but better at acidic pH, particularly at pH 6.0, 6.1, 6.2, and 6.4. Binding MFIs are plotted on the y-axis and primary antibody concentrations are plotted on the x-axis in log scale. Non-linear regressions are also shown.

Figure 8C:
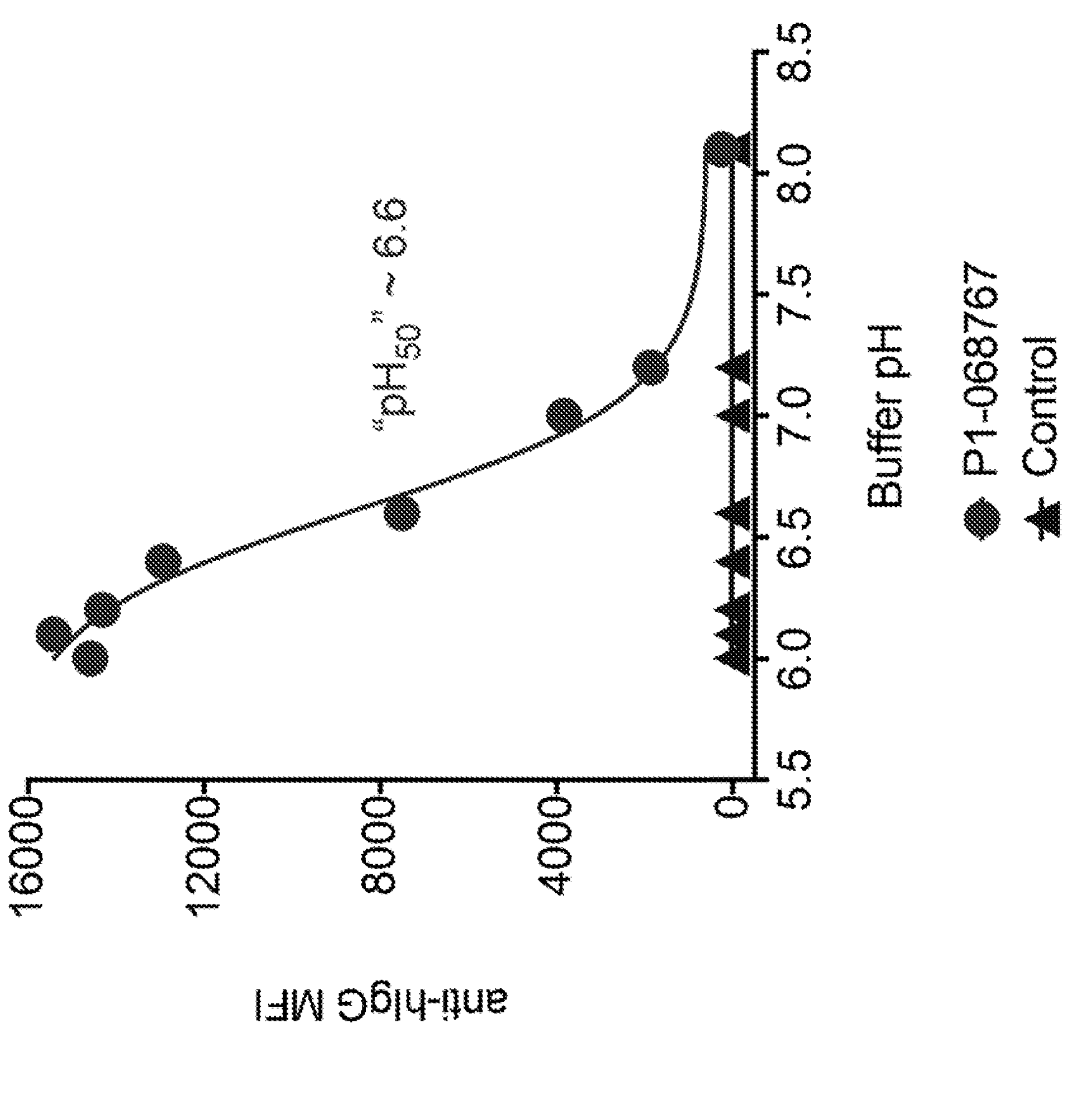

FIG. 8C shows data from the experiment described in FIGS. 8A-B measuring P1-068767 (circles) and an isotype-matched non-specific control antibody (triangles) binding to Raji cells expressing human VISTA at 3125 ng/ml at different pH. The "pH50", the pH at which 50% of P1-068767 binding is lost, is approximately 6.6. Binding MFIs are plotted on the y-axis, and buffer pH is plotted on the x-axis. Non-linear regressions are also shown.

Figure 8D:
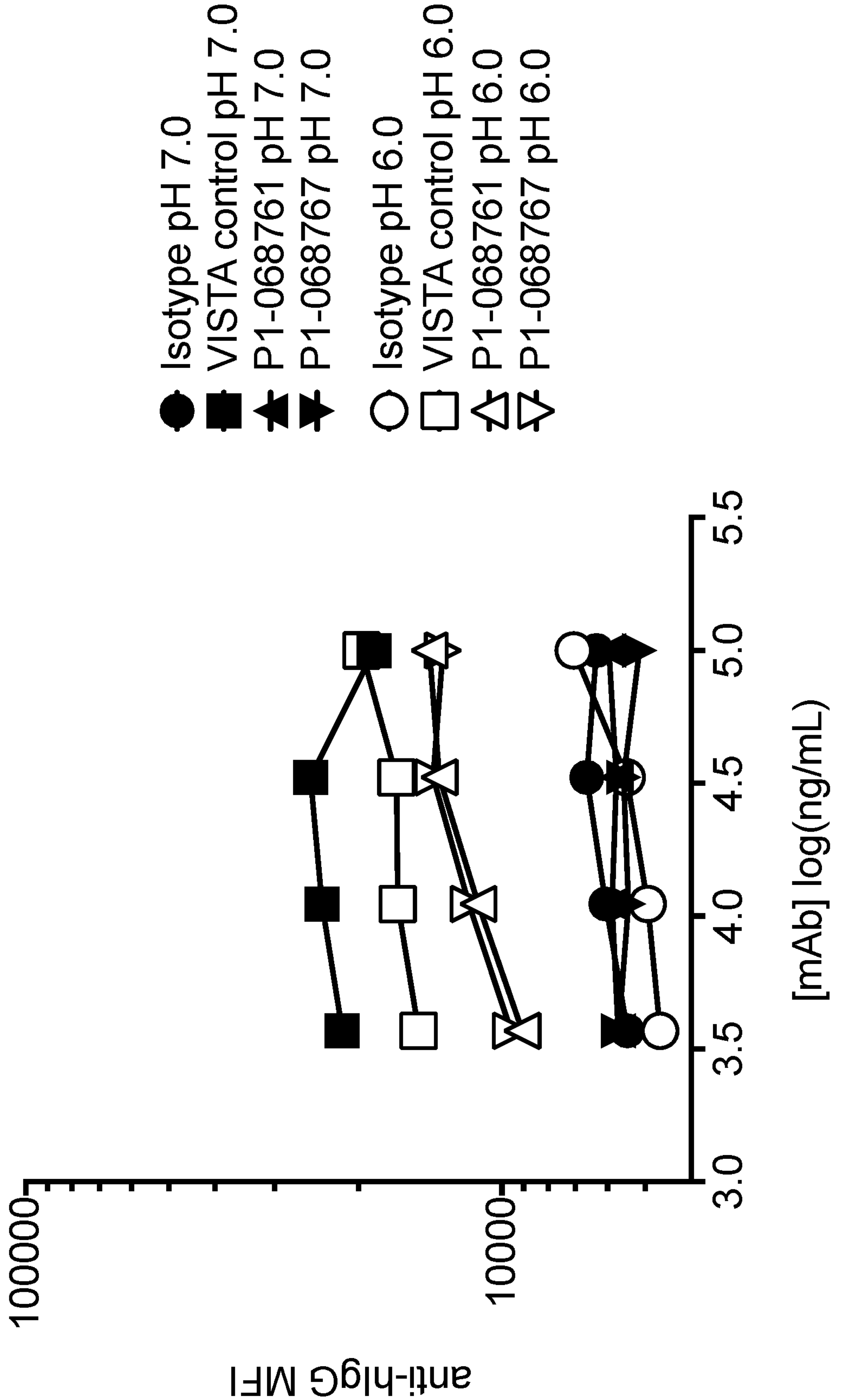

FIG. 8D shows the MFI of an isotype-matched non-specific control antibody (filled and unfilled circles for pH 7.0 and 6.0 respectively), anti-VISTA mAb 2 ("control", see FIG. 6C, filled and unfilled squares at pH 7.0 and 6.0 respectively), P1-068761 (filled and unfilled triangles for pH 7.0 and 6.0 respectively), and P1-068767 (filled and unfilled inverted triangles for pH 7.0 and 6.0 respectively) binding to human monocytes. Binding was detected as described in FIGS. 8A-B. The non-pH-selective VISTA control antibody (mAb 2) bound monocytes at both pH. Both engineered acidic pH-selective antibodies bound monocytes well at pH 6.0, but did not bind better than the non-specific isotype-matched control at pH 7.0. Thus, clones '761 and '767 have weak binding or no binding to VISTA at neutral pH, and instead bind VISTA on cells selectively at acidic pH.

Figure 8E:
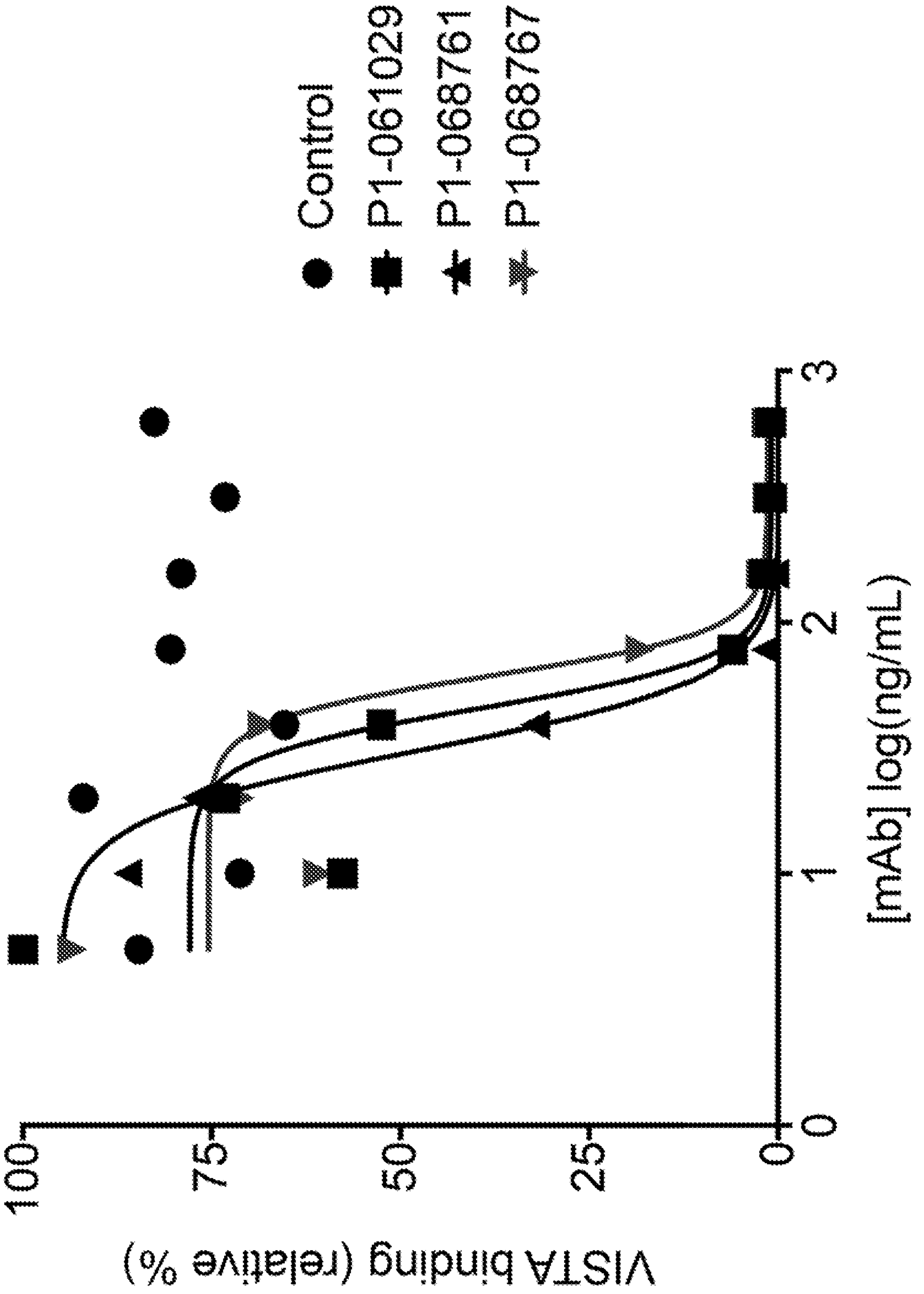

FIG. 8E shows the comparable blocking of recombinant VISTA multimer binding to activated human CD4+ T cells at pH 6.0 by '029 (squares), '761 (triangles), and '767 (inverted triangles), while a non-VISTA-specific control antibody (circles) did not block VISTA binding. This blocking assay was performed as described in Example 4. These data show that engineered acidic pH-selective VISTA antibodies are still capable of blocking VISTA receptor-ligand binding at acidic pH.

NK cell specific lysis of target cells (the same Raji cells expressing human VISTA described in FIGS. 8A-B) via antibody-dependent cell cytotoxicity (ADCC) at physiological pH was measured for the P1-061029.IgG1f, P1-068761.IgG1f, P1-068767.IgG1f antibodies, a non-VISTA-specific antibody and a non-VISTA-specific negative control antibody, all expressed as afucosylated IgG1 antibodies. NK cells were enriched from PBMC via negative bead selection (StemCell Technologies catalog number 19055) and cultured overnight in Myelocult™ media (StemCell Technologies catalog number 05150) supplemented with 1 μM hydrocortisone (StemCell Technologies catalog number 07904) and 500 U/mL recombinant human IL-2 (Peprotech catalog number 200-02). On the day of the assay, Raji cells ectopically expressing human VISTA (described in Fig. Specific lysis was interpolated from the supernatant fluorescence signal (EnVision™ plate reader). The spontaneous lysis signal obtained from co-culture without antibodies, and the maximal lysis signal was determined by lysis of target cells with Delfia® lysis buffer (PerkinElmer catalog number 4005-0010). Antibody-specific lysis was calculated to be the percentage of lysis observed divided by (the maximal lysis signal minus the spontaneous lysis signal).

Figure 8F:
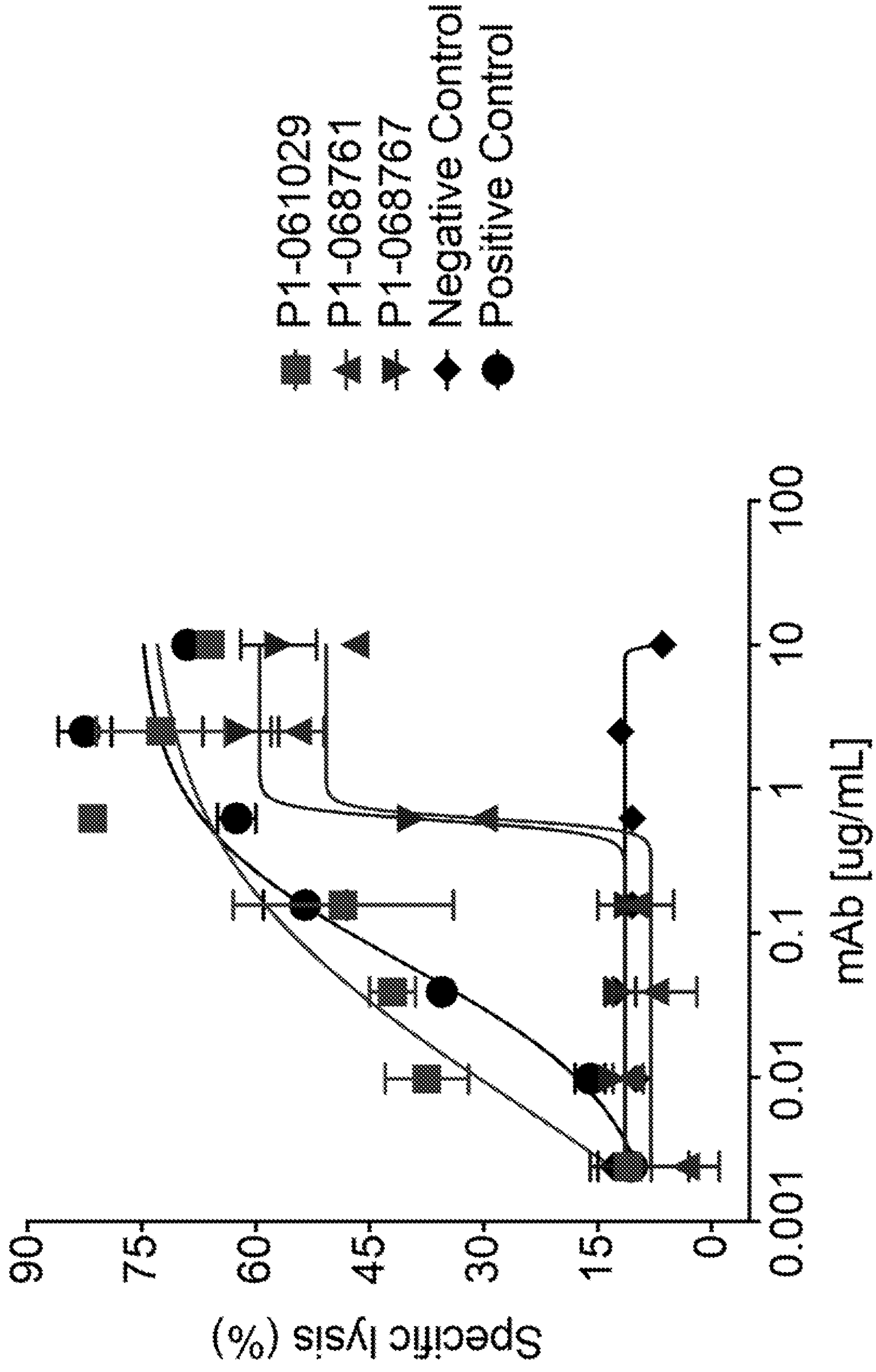

The results, which are provided in FIG. 8F, show the reduced potency of P1-068761.IgG1f and P1-068767.IgG1f, relative to P1-061029 and the positive control in mediating antibody-dependent cell cytotoxicity (ADCC) at physiological pH.

Example 12: Cyno VISTA Affinity and Pharmacokinetics of VISTA Antibodies in Cynomolgus Monkeys The pharmacokinetics of the anti-VISTA antibodies herein can be determined, for example, in cynomolgus macaque monkeys as described in this Example.

Figure 9:
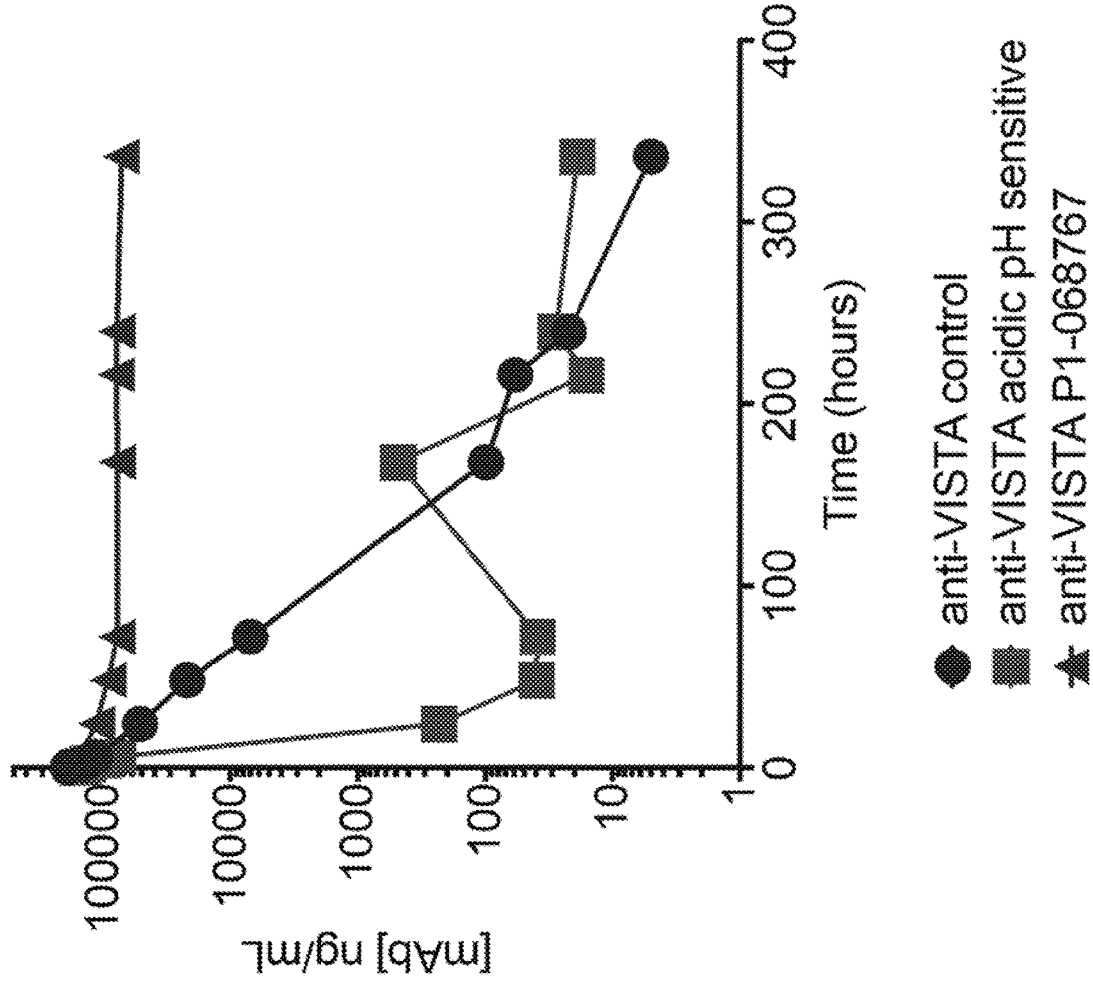
FIG. 9 shows enhanced pharmacokinetics (PK) of acidic pH-selective anti-VISTA antibodies in cynomolgus macaques. The figure shows serum antibody concentrations over time in cynomolgus macaques treated VISTA antibody 2 ("control", circles, see FIG. 6C), VISTA antibody 3 ("acidic pH sensitive", squares, see FIG. 6C), or P1-068767 (triangles).

For instance, human antibody-naïve cynomolgus macaques were injected intravenously with a single 5 mpk dose of either a VISTA antibody which binds comparably at acidic and neutral pH ("control"; mAb2), a VISTA antibody with impaired binding at acidic pH ("acidic pH sensitive", mAb3), or acidic pH-selective antibody '767, to determine the cyno PK of these antibodies. The serum concentration of each antibody following injection is shown in FIG. 9. Mean residence times for P1-068767.IgG1.3 and the control anti-VISTA antibody were 717 and 22 hours respectively, indicating that acidic pH selectivity greatly reduced VISTA antibody Target Mediated Drug Disposition (TMDD). Although the control antibody (mAb 2) and the acidic pH sensitive antibody (mAb 3) bind VISTA comparably at physiological pH, the acidic pH sensitive antibody had a lower mean residence time of 7.6 hours, demonstrating the importance of acidic pH binding to VISTA antibody recycling as described in Examples 6 and 7. The results show that acidic pH selective antibodies have superior PK and will thus more easily achieve target engagement in tumors or other microenvironments.

Cyno VISTA cross-reactivity for acidic pH-selective and control anti-VISTA antibodies can be evaluated at acidic and neutral pH. Binding affinity measurements for VISTA Abs can be conducted using a Biacore® T100 instrument (GE Healthcare) as described here. Protein A (ThermoFisher Scientific catalog number #21181) is diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay is run at 37° C. using PBST (137 mM sodium chloride, 2.7 mM potassium chloride, 10 mM phosphate buffer, 0.05% Tween 20) running buffer at pH 7.4 and 6.0. Antibodies (formatted as IgG1.3 antibodies) are diluted to 25 nM in PBST pH 7.4, and are captured across active biosensor flow cells at 5 μl/min for 45 seconds. Concentration series of 1600-0.78 nM (pH 7.4) and 100-0.78 nM (pH 6.0) monovalent

```
hVISTA-ECD (SEQ ID NO: 325) and cyno VISTA-
ECD (AFKVATLYSL YVCPEGQNVT LTCRVFGPVD
KGHDVTFYKT WYRSSRGEVQ TCSERRPIRN LTFQDLHLHH
```

-continued

```
GGHQAANTSH DLAQRHGLES ASDHHGNFSI TMRNLTLLDS
GLYCCLVVEIRHHHSEHR VH GAMELQVQTG KDAPSSCVAY
PSSSQESENI TAHHHHHHH; (SEQ ID NO: 326)
```

are prepared running buffer, and are injected over the captured antibodies at 40 μl/min to measure association and dissociation. Two 15 second injections of 10 mM glycine pH 1.5 are used to regenerate the Protein A capture surface between assay cycles. Rate constants ka ($k_{on}$) and kd ($k_{off}$) are derived from reference flow cell and 0 nM blank-subtracted sensorgrams, and are fit to a 1:1 binding model in Biacore® T200 Evaluation Software v.2.0. The affinity constant, $K_D$ is calculated as the ratio of rate constants koff/kon for each VISTA antibody. Ratios of $k_{off}$ and $K_D$ at pH 7.4/pH 6.0 are calculated to compare off-rate and affinity differences at acidic pH relative to neutral pH.

To test pharmacokinetics, human antibody-naïve cynomolgus macaques are injected intravenously with a single 5 mpk dose of either VISTA mAb2 ("control"), VISTA mAb3 ("acidic pH sensitive"), or the test antibody. The serum concentration of each antibody following injection are determined. Mean residence times for the test antibody and the control anti-VISTA antibody can be determined, as shown, for example, in FIG. 9.

Example 13: PHI Selective Binding Specificity to High pI Proteins

The binding specificity of antibody clones to VISTA and to other high pI proteins can be evaluated by SPR at neutral and acidic pHs using a Biacore® T100 instrument (GE Healthcare) according to the following protocol. Protein A (ThermoFisher Scientific catalog #21181) is diluted to 20 μg/ml in 10 mM sodium acetate pH 4.5 and immobilized onto flow cells of a CM3 biosensor following the manufacturer's amine coupling protocol (GE Healthcare), targeting 800 RU immobilization density of Protein A per flow cell. SPR experiments are conducted at 25° C. using PBST (137 mM sodium chloride, 2.7 mM potassium chloride, 10 mM phosphate buffer, 0.05% Tween 20) running buffer at pH 7.4 and 6.0. Antibodies (for example, formatted as IgG1.3 antibodies) are diluted to 50 nM in PBST pH 7.4, and captured across active biosensor flow cells at 5 μl/min for 60 seconds. A concentration series of 100-10 nM monovalent hVISTA-ECD (SEQ ID NO: 325), avidin (ThermoFisher Scientific catalog #21128), cytochrome C (Sigma catalog #C2867), BSA (Calbiochem catalog #126593), and monovalent control antigen ("Ag") is prepared in pH 7.4 and 6.0 running buffers, and is injected over the captured antibodies at 50 μl/min to evaluate binding specificity. Two 15 second injections of 10 mM glycine pH 1.5 can be used to regenerate the Protein A capture surface between assay cycles. Reference flow cell and 0 nM blank-subtracted sensorgrams can be inspected using Biacore® T200 Evaluation Software v.2.0.

Results for such an experiment performed on P1-061029 and two of its progeny antibodies P1-068761 and P1-068767 are shown in Table 13.

TABLE 13

Binding of VISTA clones to proteins having a high pI

| Sample | Isoel. pt (pI) | '029 pH 6 | '029 pH 7.4 | '761 pH 6 | '761 pH 7.4 | '767 pH 6 | '767 pH 7.4 | Anti-Ag pH 6 | Anti-Ag pH 7.4 | PBS (no Ab) pH 6 | PBS (no Ab) pH 7.4 |
|---|---|---|---|---|---|---|---|---|---|---|---|
| huVISTA-His | 6.9 | X | X | X | | X | | | | | |
| Avidin | 10 | | | | | | | | | | |
| Cyto-Chrome C | 10.7 | | | | | | | | | | |
| BSA | 4.7 | | | | | | | | | | |
| Ag-His | 6.5 | | | | | | | X | X | | |

In Table 13, specific binding, defined as >10 RU SPR binding responses at the end of the sample injection is indicated by an "X". "Anti-Ag" is an VISTA binding control Ab. The '029 clone was specific for VISTA at acidic and neutral pH. The '029 progeny clones '761 and '767 were specific for VISTA at acidic pH, while the control antibody also maintained antigen specificity. Non-specific binding ("NSB") of the pI control proteins to the Protein A reference surface was not observed in this assay. Thus, the charged amino acids introduced to the VH CDRs of '761 and '767 do not cause these antibodies to bind electrostatically to other high pI proteins, such as avidin and cytochrome C, or low pI proteins, such as BSA.

Example 14: Inhibition of T Cell Activation

This Example describes an assay that can be conducted to determine the ability of antibodies to block hVISTA inhibition of Jurkat T cell activation.

The same assay as described in Example 5 is used. Briefly, Jurkat (human T cell line) cells expressing an NFkB luciferase reporter are co-cultured at various pH with 293T cells expressing human VISTA and a single-chain variable fragment of the anti-human T cell receptor agonist antibody OKT3. Anti-VISTA antibodies or an isotype-matched non-VISTA-specific control antibody are added to the co-cultured cells. Jurkat activation is shown as luciferase units and as the fold-increase of the luciferase signal with anti-VISTA treatment relative to control.

Example 15: Mutational Analysis Identified Key Residues Conferring pH Dependent Binding Properties to VISTA Antibodies Antibodies P1-068761.IgG1.3 and P1-068767.IgG1.3 contain 5-6 mutations from P1-061029 (Table 7). A mutational analysis was conducted in order to identify key residues important for conferring the pH dependent properties of the VISTA antibodies. As such, a panel of N−1 (1 amino acid reversion to P1-061029) and N-2 (2 amino acid reversion to P1-061029) variants of P1-068761 and P1-068767 were synthesized, expressed as IgG1.3, and analyzed for their binding to huVISTA at pH 6, pH 6.7, and pH 7.4.

Binding kinetics were measured using a Biacore® T100 instrument (GE Healthcare). Protein A (ThermoFisher Scientific catalog #21181) was diluted to 20 μg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay was conducted at 37° C. using PBST (137 mM sodium chloride, 2.7 mM potassium chloride, 10 mM phosphate buffer, 0.05% Tween 20) running buffer at pH 7.4, 6.7 and 6.0. Antibodies were diluted to 25 nM in PBST pH 7.4, and were captured across active biosensor flow cells at 5 μl/min for 40 seconds. A concentration series of 100-10 nM monovalent hVISTA-ECD (SEQ ID NO: 325) was prepared in pH 7.4, 6.7 and 6.0 running buffers, and was injected over the captured antibodies at 40 μl/min to measure association and dissociation. Two 15 second injections of 10 mM glycine pH 1.5 were used to regenerate the Protein A capture surface between assay cycles. Rate constants ka (kon) and kd ($k_{off}$) were derived from reference flow cell and 0 nM blank-subtracted sensorgrams, and were fit to a 1:1 binding model in Biacore® T200 Evaluation Software v.2.0.

The affinity constant, $K_D$ was calculated as the ratio of rate constants $k_{off}$/kon for each VISTA antibody. The % Rmax was calculated to compare how pH affects an antibody's binding capacity for VISTA, and represents the measured maximal VISTA binding response relative to the expected maximal VISTA binding response. The % Rmax is defined as the ratio of the reference-subtracted 'binding' report point response at the end of the 100 nM VISTA injection for each antibody (Rmax) relative to the expected VISTA binding response (Rexp). Rexp is calculated as Rexp=[(VISTA-ECD molecular weight/mAb molecular weight)×(mAb 'capture' report point response (RUs)]×2 binding sites per mAb.

The SPR results obtained for P1-068761 reversion variants are shown in FIG. 10A, which is ranked by the pH 6.0 $k_{off}$, slowest to fastest. In the table, antibodies that exhibited weak or no binding response (<10 RU) to 100 nM hVISTA were categorized as non-binding (NB). The results indicate that E at positions 32 (i.e., amino acid residue 7 in VH CDR1 of '761) and 100f (amino acid residue 12 in VH CDR3 of '761) are both required for maintaining acidic pH selectivity, since these reversions to P1-061029 parent sequence allowed for significant hVISTA binding at physiological pH (% Rmax>10). Further analysis revealed that variants with E55A (amino acid residue 6 in VH CDR2 of '761) reversion maintained acidic pH-selectivity and exhibited comparable binding kinetics within 2-fold of P1-068761. In contrast, while variants with H100G, E56N and E30D (amino acid residues 12 of VH CDR3, 7 of VH CDR2 and 4 of VH CDR1 of '761, respectively) reversions maintained acidic pH selectivity, these mAbs also exhibited ~3-fold faster $k_{off}$ at acidic pHs compared to P1-068761, bringing the off-rates of these mutants at acidic pH closer to the P1-061029 parent. Thus, adding G100H, N56E and/or D30E mutations to the original P1-061029 clone contributed to acidic pH VISTA affinity improvements observed in the acidic selective P1-068761 clone.

The SPR results obtained for P1-068767 reversion variants are shown in FIG. 10B, which is ranked by the pH 6.0 $k_{off}$, slowest to fastest. The results indicate that D at position 102 (amino acid residue 14 in VH CDR3 of '767) was required for maintaining acidic pH selectivity, and D102V reversion back to P1-061029 parent sequence allowed for significant hVISTA binding at neutral pH (% Rmax>10). Further analysis revealed that variants with E30D, D52N and E55A (amino acid residues 4 of VH CDR1, 3 of VH CDR2 and 6 of VH CDR3 of '767, respectively) reversions maintained acidic pH-selectivity and exhibited comparable pH 6.0 binding kinetics within 2-fold of P1-068767. In contrast, variants with E100fF (amino acid residue 12 of VH CDR3 of '767) reversion maintained acidic pH selectivity, albeit with >3-fold faster $k_{off}$ at acidic pH compared to P1-068767. Notably, variants with E100fF reversion exhibited even faster $k_{off}$ at acidic pH compared to the parent mAb P1-061029.

Example 16: Biophysical Properties of VISTA Antibodies

The physical and chemical properties of the P1-068744, P1-068748, and their respective progeny antibodies, can be compared to that of the parent P1-061015 antibody (for instance, all with an IgG1.3 constant region) by the following analytical and biophysical techniques as described in this example.

Analytical SEC data are acquired using an Agilent 1260 HPLC instrument using a Shodex™ KW403-4F column (4.6 mmID×300 mmL), in buffer containing 100 mM Sodium Phosphate, 150 mM Sodium Chloride, pH7.3 (0.2 μm filtered) running at a flow rate of 0.30 mL/min. Data are collected by an Agilent 1260 Infinity Diode Array Detector set to collect at 280 nm and analyzed by Agilent Chemstation software (Agilent, Santa Clara, CA). Imaged capillary isoelectric focusing (icIEF) data are acquired on a ProteinSimple iCE3 Instrument with Alcott 720NV Autosampler. Antibody samples are mixed with a separation mixture to yield final concentrations of 0.2 mg/ml antibody, 0.35% methyl cellulose, 2.0 M Urea, 1% v/v pharmalyte pI 5-8, and 3% v/v pharmalyte pI 8-10.5. These samples are analyzed using a pre-focus time of 1 min at 1500V, and focusing time of 10 min at 3000V, in a ProteinSimple cIEF cartridge FC-coated (product #101701). Data are analyzed using iCE CFR Software V4.3.1.5352.

Antibody hydrodynamic size is determined by dynamic light scattering (DLS) and thermal stability was characterized by fluorescence spectroscopy and static light scattering (SLS) using an UNcle molecular characterization instrument (Unchained Labs). Antibodies are prepared at a concentration of 2 mg/ml in 1×PBS buffer, and then diluted 1:1 with either 40 mM Tris in 1×PBS, or 40 mM citrate in 1×PBS, at different pH to yield final samples of 1 mg/ml antibody in either 20 mM Tris/1×PBS, or 20 mM citrate/1×PBS at pH 3.0, 4.0, 5.0, 6.0, 7.0, 8.0 or 9.0. These samples are loaded into a UNi cuvette cartridge and analyzed within 1 hour of dilution into the different pH formulations. DLS data are collected at 25° C., using 4 acquisitions of 5 s each. Intensity autocorrelation functions are fitted using UNcle analysis software version V2.0. Thermal denaturation data is obtained by scanning samples from 25° C. to 90° C. at a scan rate of 0.5°/min, with excitation at 266 nm and 473 nm. Fluorescence data is acquired over a range of 250 nm-720 nm. Fluorescence and SLS data are analyzed using UNcle analysis software version V2.0.

The apparent viscosity of the antibodies is measured on an UNcle molecular characterization instrument (Unchained Labs), using a bead-based DLS method that measures the diffusion rate of polystyrene beads in the presence of formulated antibody solutions, as per Unchained Labs's recommended protocol. Briefly, a 10% solution of 100 nm polystyrene beads (Thermo Scientific cat #3100A) is prepared in formulation buffer containing 0.5% Tween 80. 3 μl of this polystyrene bead mixture is added to 30 μl of formulated antibody (various Ab concentrations in 20 mM histidine, 260 mM sucrose pH 6.0) and the resulting protein/bead mixture is loaded into 3 separate lanes of a UNi cuvette cartridge (9 μl each lane) for triplicate analysis. Data are analyzed using UNcle analysis software version V2.0, using a reference viscosity of 1.3 cP.

The physical stability of antibodies is studied under accelerated stress conditions by preparing 50 mg/ml antibody samples in 20 mM histidine, 260 mM sucrose pH 6.0 and exposing to 40° C. thermal stress for 4 weeks. Aliquots are removed immediately prior to 40° C. incubation (time zero=t0), as well as after 1 week (1 w) and 4 weeks (4 w) of thermal stress, and samples are diluted to 2 mg/ml using formulation buffer and analyzed by aSEC. The aSEC data are acquired using an Agilent 1260 HPLC instrument using a Shodex KW403-4F column (4.6 mmID×300 mmL), in buffer containing 100 mM Sodium Phosphate, 150 mM Sodium Chloride, pH7.3 (0.2 μm filtered) running at a flow rate of 0.30 mL/min. Data are collected by an Agilent 1260 Infinity Diode Array Detector set to collect at 280 nm and analyzed by Agilent Chemstation software (Agilent, Santa Clara, CA).

The oligomeric state of the antibodies is determined over the pH range of 3-9 using dynamic light scattering (DLS) in buffers of different pH. A hydrodynamic radius (Rh) value in the range of 4.8-5.7 nM is typical for monomeric antibody samples.

Thermal stability can be measured over the pH range of 3-9 by monitoring fluorescence and static light scattering as a function of temperature in buffers of different pH. The first thermal denaturation transition (Tm1) which typically represents denaturation of the CH2 domain of IgG1 antibodies is determined by fluorescence, and the onset of aggregation (Tagg) which typically represents denaturation of the FAB domain of IgG1 antibodies is measured by static light scattering.

Results from experiments performed on P1-061029 and its P1-061761 and P1-061767 progeny antibodies, for example, are as follows. Analytical size exclusion chromatography (aSEC) data showed that all three antibodies could be purified to high purity, with each antibody sample consisting of more than 99.3% monomer (main peak), less than 0.7% high molecular weight (HMW) species, and undetectable levels of low molecular weight (LMW) species, Table 14.

TABLE 14

Analytical SEC data for anti-VISTA antibodies, showing the percentage of high molecular weight species (% HMW), percentage of monomeric/main species (% Main) and percentage of low molecular weight species (% LMW).

| Sample Name | % HMW | % Main | % LMW |
|---|---|---|---|
| P1-061029 | 0.4 | 99.6 | 0.0 |
| P1-068761 | 0.6 | 99.4 | 0.0 |
| P1-068767 | 0.5 | 99.5 | 0.0 |

Figure 12A:
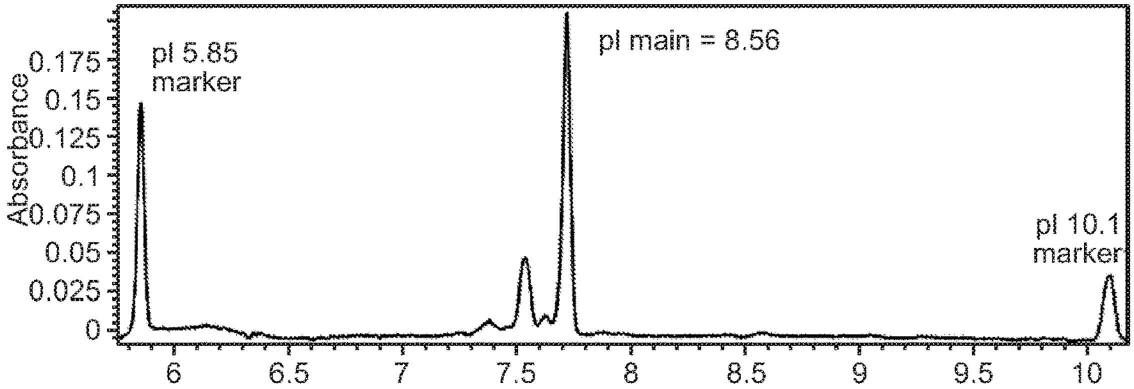
FIGS. 12A-C show imaged capillary isoelectric focusing (icIEF) data for the following.
Figure 12B:
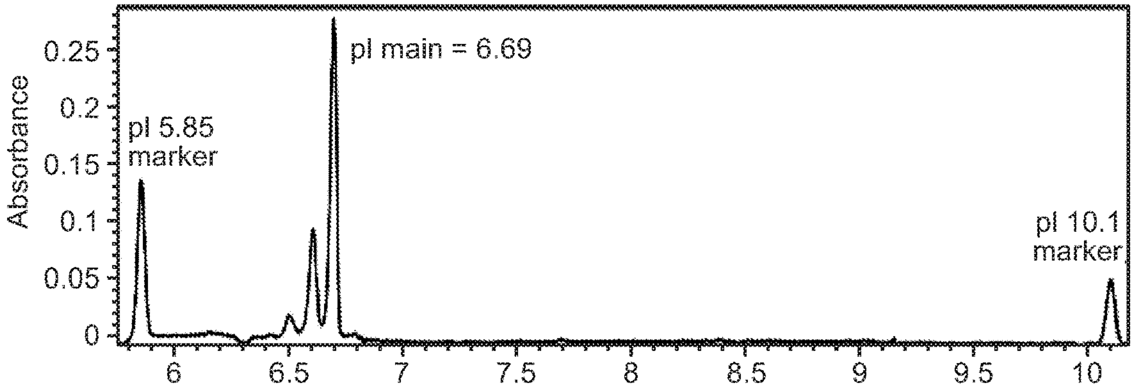
Figure 12C:
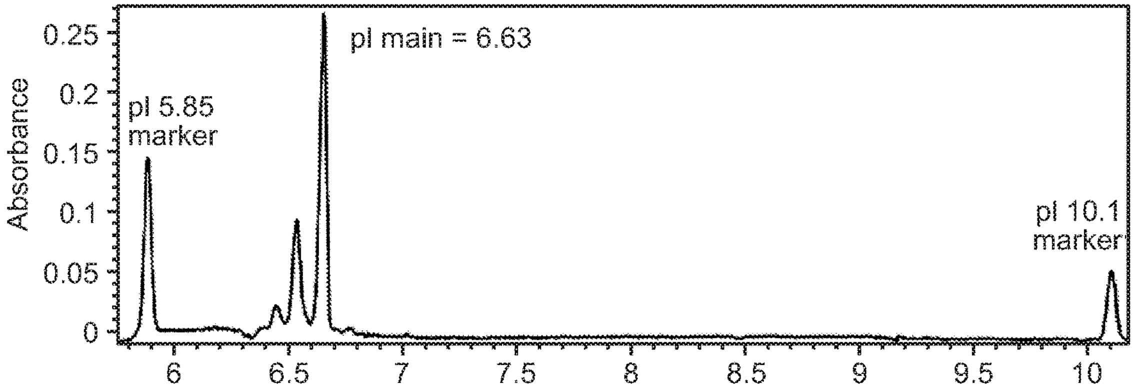

The charge variant profile as determined by imaged capillary isoelectric focusing (icIEF) for antibody P1-061029 showed the presence of a main species (69.4%) with isoelectric point (pI) of 8.56, and 30.6% acidic species. (FIG. 12A-C.) P1-068761 demonstrated a main species (66.4%) with pI of 6.69 and 33.6% acidic species. P1-068767 demonstrated a main species (61.4%) with pI of 6.63 and 38.6% acidic species. Therefore, the distribution of acidic, basic and main species is similar for the three antibodies but the engineered antibodies P1-068761 and P1-068767 have significantly lower isoelectric point than the parental P1-061029 antibody.

The oligomeric state of P1-061029, P1-068761, and P1-068767 was determined over the pH range of 3-9 using dynamic light scattering (DLS) in buffers of different pH. All hydrodynamic radius (Rh) values for each antibody were in the range of 4.8-5.7 nM, which is typical for monomeric antibody samples, Table 15. This suggests that these antibodies do not form detectable levels of high molecular weight aggregated species at 1 mg/ml within the first hour after dilution into formulations having pH between 3-9.

TABLE 15

The hydrodynamic radius as determined by DLS for 1 mg/ml samples of anti-VISTA antibodies across the pH range of pH3-pH9.

| pH | Buffer | Rh (nm) P1-061029 | Rh (nm) P1-068761 | Rh (nm) P1-068767 |
|---|---|---|---|---|
| 9 | 20 mM Tris/1 × PBS | 5.2 | 4.8 | 5.2 |
| 8 | 20 mM Tris/1 × PBS | 5.2 | 5.2 | 5.2 |
| 7 | 20 mM Tris/1 × PBS | 4.8 | 5.2 | 5.2 |
| 7 | 20 mM citrate/1 × PBS | 4.8 | 5.2 | 5.7 |
| 6 | 20 mM citrate/1 × PBS | 5.2 | 5.2 | 4.8 |
| 5 | 20 mM citrate/1 × PBS | 5.2 | 4.8 | 5.2 |
| 4 | 20 mM citrate/1 × PBS | 4.8 | 4.8 | 5.2 |
| 3 | 20 mM citrate/1 × PBS | 5.2 | 5.2 | 5.2 |

The thermal stability of P1-061029, P1-068761, and P1-068767 was measured over the pH range of 3-9 by monitoring fluorescence and static light scattering as a function of temperature in buffers of different pH. The first thermal denaturation transition (Tm1) which typically represents denaturation of the CH2 domain of IgG1 antibodies was determined by fluorescence and is shown in Table 16, and the onset of aggregation (Tagg) which typically represents denaturation of the FAB domain of IgG1 antibodies was measured by static light scattering and is shown in Table 17. At neutral pH (pH 7.0) in Tris/PBS formulation the Tm1 values for the three antibodies were P1-061029 (67.4° C.), P1-068761 (67.0° C.), and P1-068767 (65.3° C.), with Tagg values of P1-061029 (67.8° C.), P1-068761 (67.5° C.), and P1-068767 (65.8° C.). The Tm1 for each antibody in Citrate/PBS formulation at the same neutral pH 7.0 or slightly more acidic pH of 6.0 were all within 0.7° of the Tris/PBS pH 7.0 values. However, Tm1 values were slightly lower (between 0.3°-1.1° lower) at more basic pH of 8-9, and significantly lower at more acidic pH of 3-5, for each antibody. Compared to neutral pH, the Tagg for P1-061029 was within 0.1° of pH 7.0 value at more basic pH 8.0-9.0, was 1.0° lower at pH 5.0, and much lower (6.1°-19.6° lower) at the most acidic pH conditions pH 3.0-4.0. The Tagg for P1-068761 and P1-068767 were also significantly lower at pH 3.0-4.0. However at pH 5.0 the Tagg for P1-068761 was only 0.2° lower than Tagg at pH 6.0, whereas Tagg for P1-068767 was 2.2° lower at pH 5.0 than at pH 6.0, demonstrating some differences in Tagg for each antibody, Table 17.

TABLE 16

Thermal stability (Tm1 values) for P1-061029, P1-068761, P1-068767 across the pH range of pH3-pH 9 as determined by fluorescence spectroscopy

| pH | Buffer | Tm1 (° C.) P1-061029 | Tm1 (° C.) P1-068761 | Tm1 (° C.) P1-068767 |
|---|---|---|---|---|
| 9 | 20 mM Tris/1 × PBS | 66.6 | 65.9 | 65.0 |
| 8 | 20 mM Tris/1 × PBS | 67.0 | 66.5 | 64.8 |
| 7 | 20 mM Tris/1 × PBS | 67.4 | 67.0 | 65.3 |
| 7 | 20 mM citrate/1 × PBS | 67.2 | 66.9 | 64.8 |
| 6 | 20 mM citrate/1 × PBS | 67.6 | 67.5 | 65.0 |
| 5 | 20 mM citrate/1 × PBS | 64.4 | 64.7 | 62.1 |
| 4 | 20 mM citrate/1 × PBS | 51.8 | 52.0 | 50.8 |
| 3 | 20 mM citrate/1 × PBS | 30.7 | 28.1 | 28.7 |

-continued

TABLE 17

Thermal stability (Tagg values) for P1-061029, P1-068761, P1-068767 across the pH range of pH3-pH 9 as determined by static light scattering

| pH | Buffer | Tagg (° C.) P1-061029 | Tagg (° C.) P1-068761 | Tagg (° C.) P1-068767 |
|---|---|---|---|---|
| 9 | 20 mM Tris/1 × PBS | 67.7 | 67.1 | 66.0 |
| 8 | 20 mM Tris/1 × PBS | 67.8 | 67.5 | 65.8 |
| 7 | 20 mM Tris/1 × PBS | 67.8 | 68.2 | 65.9 |
| 7 | 20 mM citrate/1 × PBS | 67.8 | 68.1 | 65.7 |
| 6 | 20 mM citrate/1 × PBS | 68.1 | 68.9 | 65.6 |
| 5 | 20 mM citrate/1 × PBS | 66.8 | 68.7 | 63.7 |
| 4 | 20 mM citrate/1 × PBS | 61.7 | 63.6 | 56.9 |
| 3 | 20 mM citrate/1 × PBS | 48.2 | 48.8 | 41.0 |

The apparent viscosity of P1-061029, P1-068761, and P1-068767 was measured using a bead-based DLS method which measures the diffusion rate of polystyrene beads in the presence of formulated antibody solutions. Comparison of all three antibodies at 44 mg/ml shows similar viscosity for both engineered antibodies as the parent antibody under these conditions, Table 18. In a second study additional protein material for P1-068761 and P1-068767 was concentrated to higher concentrations to analyze viscosity at 136 mg/ml, 100 mg/ml, and 50 mg/ml. These data show increased apparent viscosity at higher antibody concentrations, with maximum apparent viscosity of 5.7±0.7 for P1-068761 and 5.3±0.6 for P1-068767 at 136 mg/ml.

TABLE 18

Apparent viscosity (in cP) for antibodies in 20 mM histidine, 260 mM sucrose pH 6.0 at 25° C. as determined by bead based DLS method. Values represent the average and standard deviation of data from three UNi lanes

| Antibody | Apparent Viscosity (cP) @ 136 mg/ml | Apparent Viscosity (cP) @ 100 mg/ml | Apparent Viscosity (cP) @ 50 mg/ml | Apparent Viscosity (cP) @ 44 mg/ml |
|---|---|---|---|---|
| P1-061029 | | | | 1.6 ± 0.1 |
| P1-068761 | 5.7 ± 0.7 | 3.1 ± 0.0 | 1.4 ± 0.2 | 1.5 ± 0.4 |
| P1-068767 | 5.3 ± 0.6 | 3.0 ± 0.3 | 1.7 ± 0.2 | 1.6 ± 0.2 |

The physical stability of 50 mg/ml samples of P1-061029, P1-068761, and P1-068767 in 20 mM histidine, 260 mM sucrose pH 6.0 was studied under accelerated stress conditions of 40° C. for 4 weeks. The oligomeric state of the antibodies was monitored by aSEC for samples immediately prior to 40° C. incubation (time zero=t0), as well as after 1 week (1w) and 4 weeks (4w) of 40° C. stress. These data show that all three antibodies remain more than 96% monomeric after 4 weeks at 40° C., with low levels of HMW species (<1.6% HMW) and low levels of LMW species (<2.0% LMW), Table 19.

TABLE 19 aSEC data for anti-VISTA antibody accelerated stability samples, showing the percentage of high molecular weight species (% HMW), percentage of monomeric/main species (% Main) and percentage of low molecular weight species (% LMW), for t0, 1w, and 4w samples

| Antibody | Sample | % HMW | % Main | % LMW |
|---|---|---|---|---|
| P1-061029 | t0 | 0.4 | 99.7 | 0.0 |
| | 1w | 0.5 | 99.4 | 0.2 |
| | 4w | 0.8 | 97.2 | 2.0 |

TABLE 19-continued aSEC data for anti-VISTA antibody accelerated stability samples, showing the percentage of high molecular weight species (% HMW), percentage of monomeric/main species (% Main) and percentage of low molecular weight species (% LMW), for t0, 1w, and 4w samples

| Antibody | Sample | % HMW | % Main | % LMW |
|---|---|---|---|---|
| P1-068761 | t0 | 0.6 | 99.4 | 0.0 |
| | 1w | 0.9 | 98.8 | 0.3 |
| | 4w | 1.6 | 96.4 | 2.0 |
| P1-068767 | t0 | 0.5 | 99.5 | 0.0 |
| | 1w | 0.8 | 98.9 | 0.3 |
| | 4w | 1.6 | 96.4 | 2.0 |

Example 17: Generation of Anti-VISTA Antibodies with Germline Heavy Chain or Light Chain Framework Region Substitutions Anti-VISTA antibodies can be further mutated in their variable region framework sequences. For example, they may be further modified so that framework regions more closely resemble those found in the human germline sequences.

For example, light chain amino acid residue 85 in P1-061015, P1-068744, P1-068748, and their respective progeny is a T, whereas in the human germline sequence it is a V. Thus, in some embodiments, this residue can be mutated back to a V. For example, in certain embodiments, antibodies P1-061015, P1-068744, P1-068748 and derivatives thereof comprise a light chain wherein amino acid residue 85 is a V. In such antibodies, the light chain comprises a framework region comprising the sequence D82FAVYY87 (positions 82-87 of SEQ ID NO: 569) instead of D82FATYY 87 (positions 82-87 of SEQ ID NO: 96).

Example 18: Anti-VISTA Antibody and Anti-PD-1 Antibody Act Synergistically to Elicit Tumor Rejection To characterize the effects of blocking VISTA's acidic pH-selective ligand interface in a tumor, a mouse surrogate antibody, VISTA. 10, was produced, which blocks mouse VISTA binding to mouse T cells at acidic pH. (VISTA.10 also binds m VISTA at physiological pH.) To avoid Fc receptor engagement and any subsequent effector functions, VISTA. 10 was converted to an IgG1 isotype with a point mutation, D265A, to avoid Fc receptor engagement and effector functions {Clynes, 2000}. MC38 tumors were implanted subcutaneously in mice, and when the tumors reached about 70 $mm^2$, the following treatments were administered every three days to the mice: Group 1:4 doses of anti-KLH mIgG1-D265A at 30 mpk; Group 2: two doses of anti-PD-1 mIgG1-D265A at 5 mg/kg; Group 3:4 doses of anti-VISTAmIgG1-D265A at 30 mg/kg; and Group4: anti-PD-1+anti-VISTA combination. Combination treatment of VISTA.10 and a PD-1 blocking antibody elicited tumor rejection in most mice implanted with MC38 colorectal adenocarcinoma tumors (FIG. 15A-D) anti-PD-1 and VISTA.10 single agent treatments modestly delayed, but did not prevent, tumor progression (FIG. 15A-D).

Figure 15A:
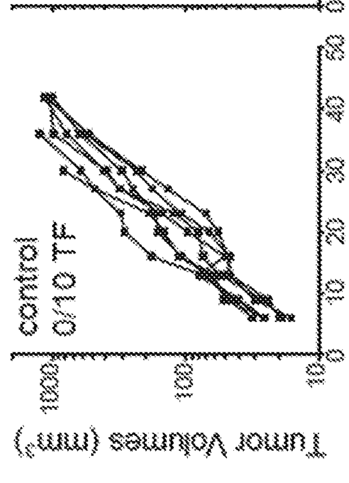
FIGS. 15A-O: Wildtype C57BL6 mice were implanted with MC38 tumors and treated with non-binding isotype-matched control antibodies (black squares), mouse VISTA blocking antibody VISTA. 10 (upward triangles), a mouse PD-1 blocking antibody (squares), or a combination of VISTA and PD-1 blocking antibodies (downward triangles). All antibodies were mouse IgG1-D265A (Fc-inert) isotype. (See FIGS. 15A-D.) These data are representative of three independent experiments.
Figure 15B:
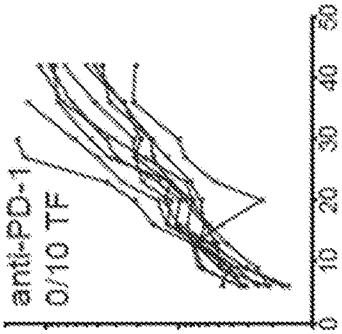
Figure 15C:
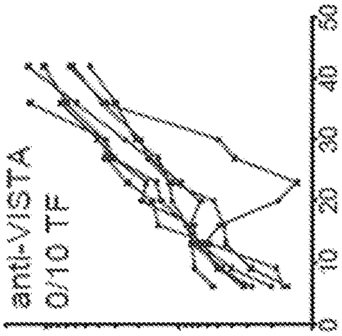
Figure 15D:
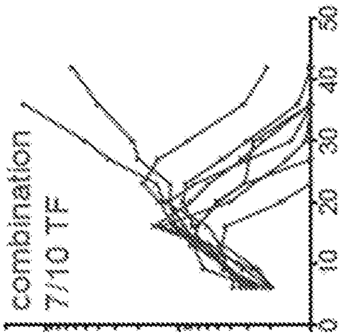
Figure 15E:
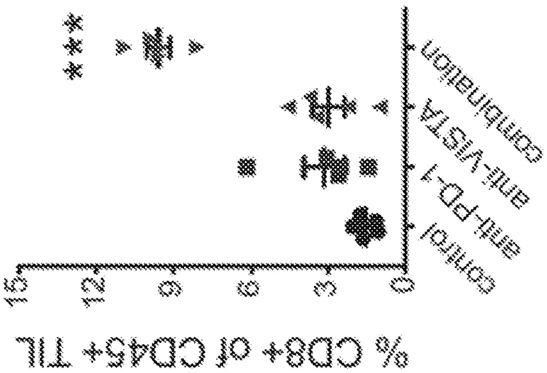
FIGS. 15E and F show the frequency of intratumoral CD8+ T cells and CD4+ T cells 7 days after the start of treatment. n=5 per group. One-way ANOVA with Dunnett's multiple comparisons, P=0.0001.
Figure 15F:
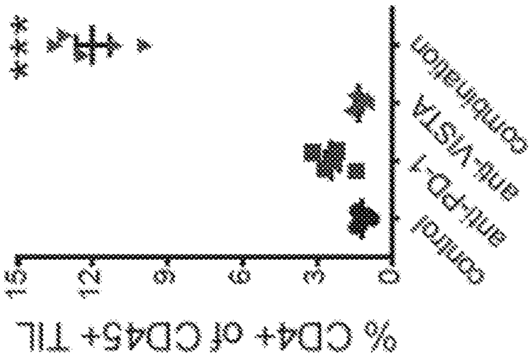
Figure 15H:
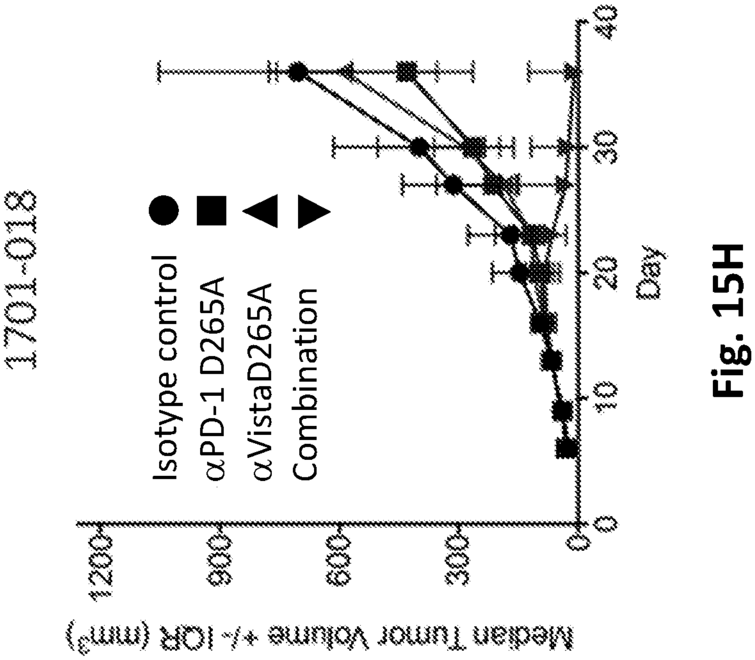
Figure 15G:
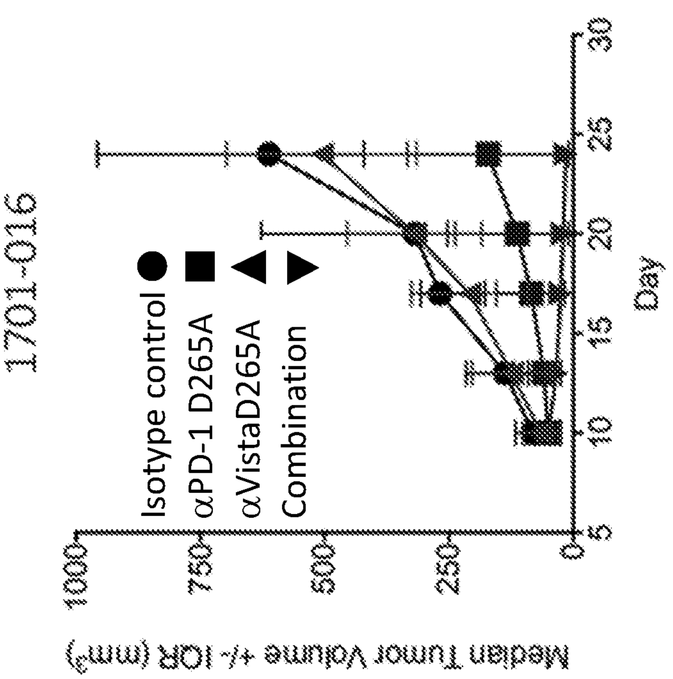
FIGS. 15G and H show results for individual mice shown in FIGS. 15A-D.

Consistent with these results, ex vivo analysis of tumors from treated mice showed 5- and 10-fold increases in the frequencies of tumor-infiltrating CD8+ T cells and CD4+ T cells, respectively, in mice treated with VISTA.10 and anti-PD-1 (FIG. 15E-F). Other leukocyte subsets were largely unaffected. Combination therapy also resulted in significantly lower expression of PD-1, LAG-3 and TIM-3, all markers of T cell exhaustion and dysfunction, on tumor-infiltrating CD8+ T cells (FIG. 15E). Treatment with PD-1 or VISTA antibodies alone had only modest effects on T cell frequencies and phenotype (FIGS. 15E-F). Intratumoral myeloid cell subset frequencies, including those of macrophages, monocytic myeloid-derived suppressor cells (MDSC), and granulocytic MDSC, were largely unaffected by VISTA antibody treatment.

Figure 15I:
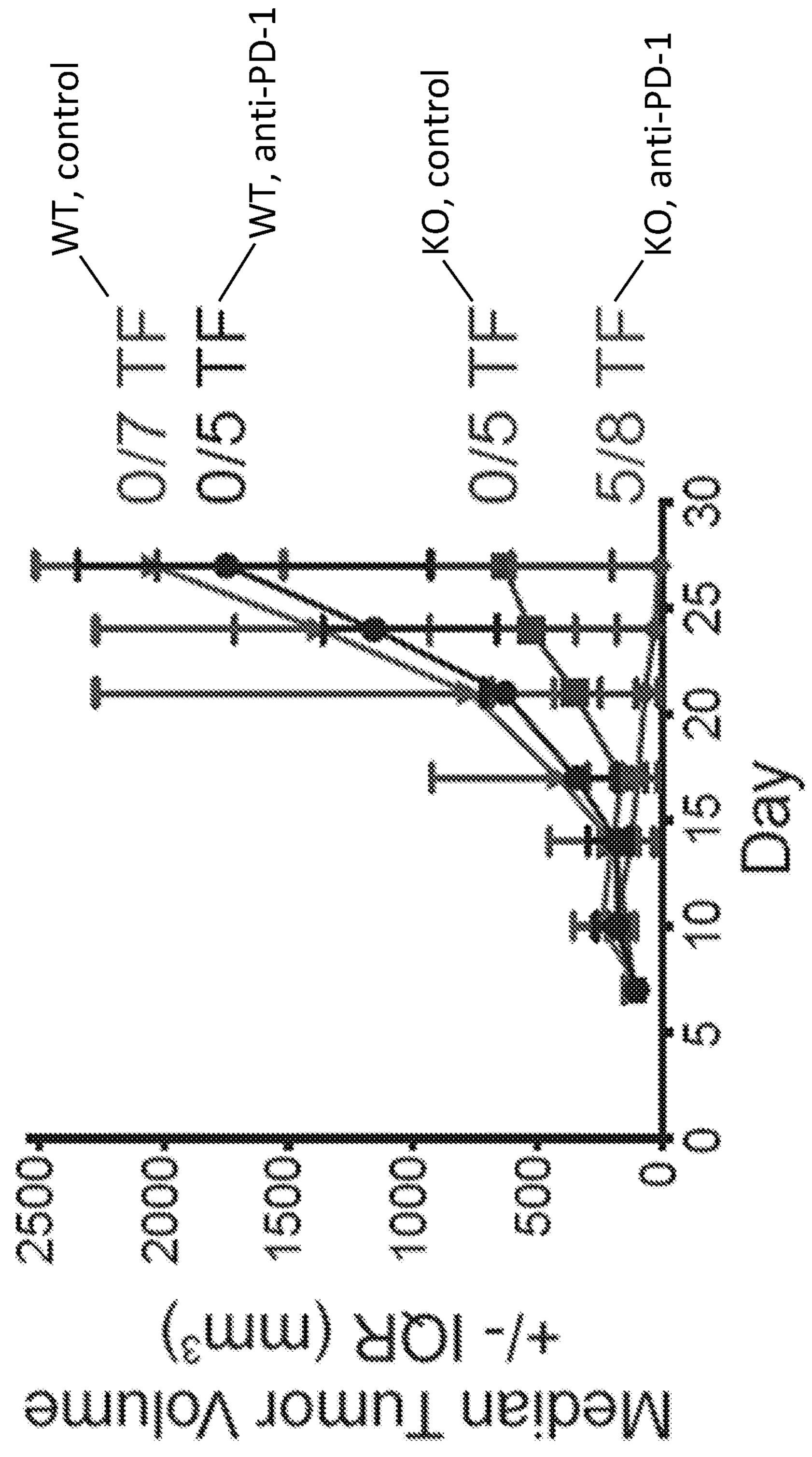
FIG. 15I: VISTA knockout mice and wildtype littermates were implanted with MC38 tumors and treated with non-binding isotype-matched control antibodies (upper two curves (0/7 TF and 0/5 TF, marked with circles and downward triangles) or with a mouse PD-1 blocking antibody (lower two curves 0/5 TF and 5/8 TF, marked with squares and downward triangles). Median tumor growth and the number of mice that were tumor-free (TF) at the end of the study vs. the total number of mice are shown next to each curve (e.g, 0/7 TF). These data are representative of two independent experiments. Error bars depict the interquartile range.
Figure 15K:
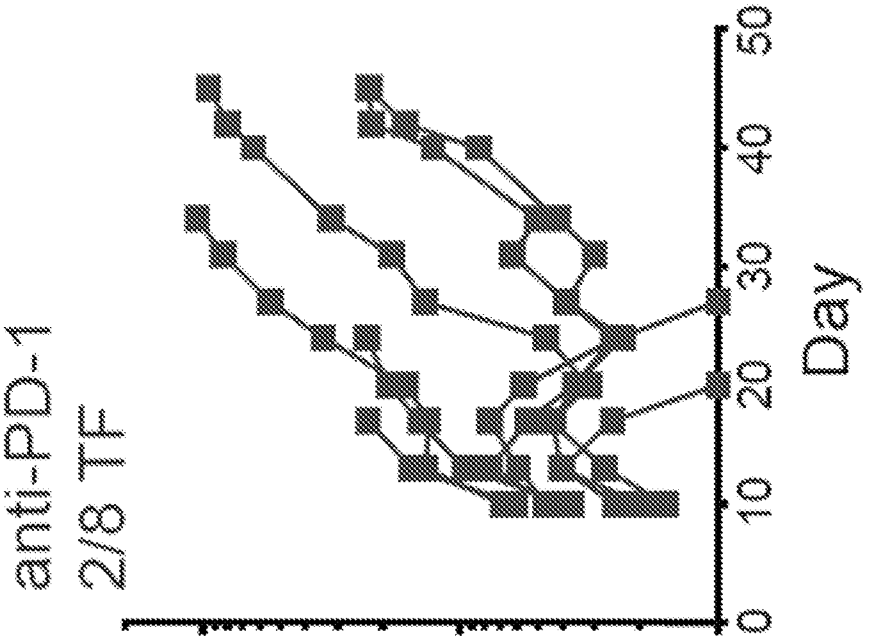
FIGS. 15J-M show the tumor volumes of human VISTA knock-in (KI) mice implanted with MC38 tumors and treated with non-binding isotype-matched control antibodies (FIG. 15J), a mouse PD-1 blocking antibody (FIG. 15K), a combination of mouse PD-1 blocking antibody and the non-pH-selective human VISTA blocking antibody P1-061029 (FIG. 15L), or a combination of mouse PD-1 blocking antibody and the acidic pH-selective human VISTA blocking antibody P1-068767 (FIG. 15M). All antibodies were mouse IgG1-D265A isotype. Tumor volumes over time are shown. n=5-8 per group. These data are representative of one independent experiment.
Figure 15J:
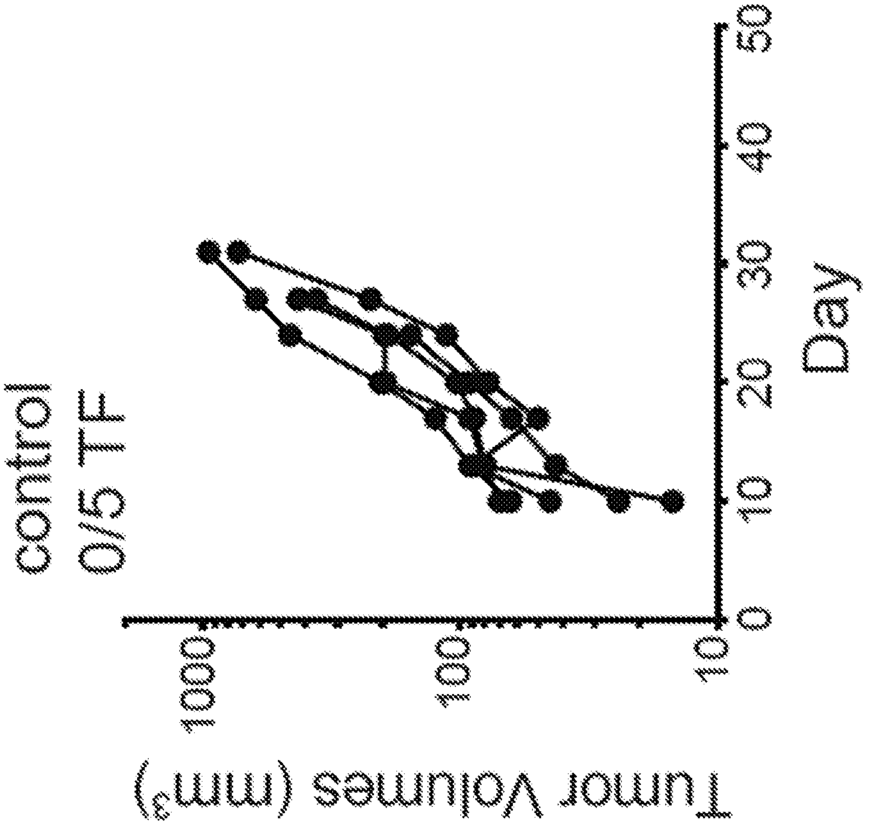
Figure 15M:
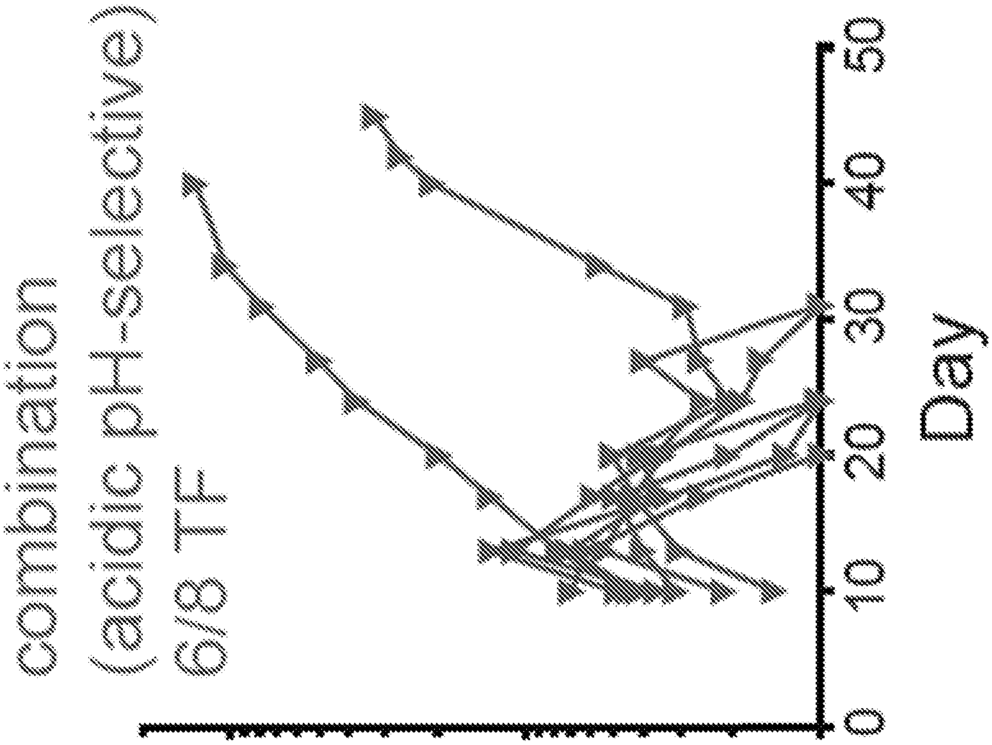
Figure 15L:
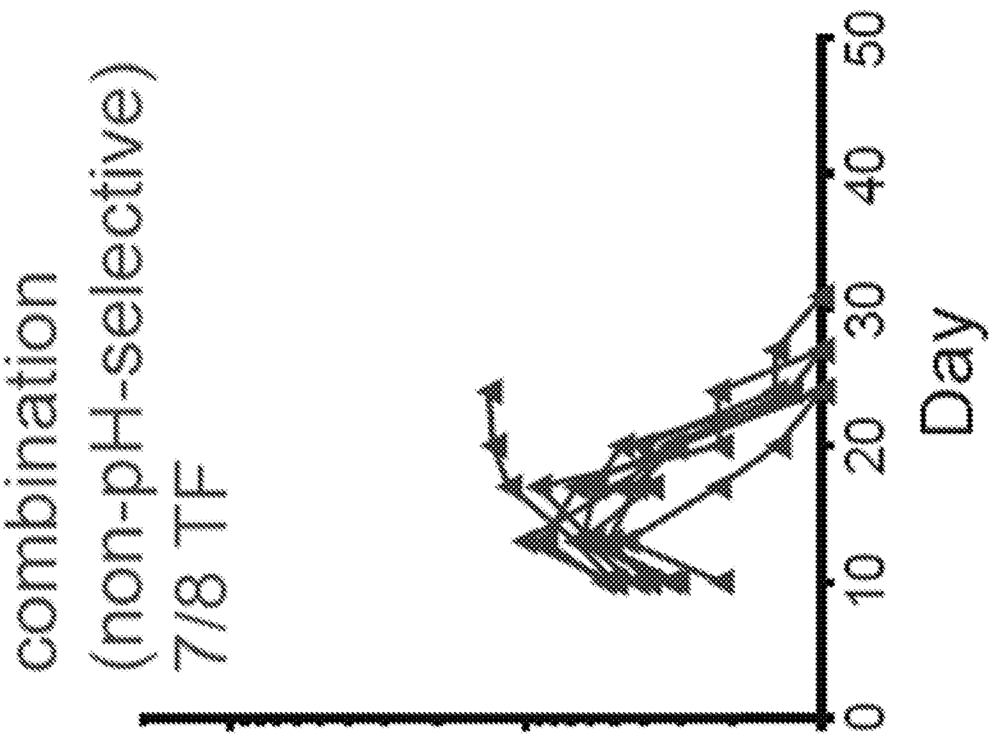

To contextualize VISTA antibody activity, VISTA knockout mice were implanted with MC38 tumors and treated with PD-1 blocking or control antibodies. As shown in FIG. 15I, in the control treatment groups, MC38 tumors grew comparably in VISTA knockout mice and their wildtype littermates. VISTA knockout mice exhibited increased responsiveness to anti-PD-1, reminiscent of VISTA and PD-1 combination efficacy. This responsiveness was again correlated with increased intratumoral CD4+ and CD8+ T cells. These data indicate that antibodies that block VISTA binding at acidic pH are sufficient to reverse VISTA-mediated immune suppression.

Because VISTA functions selectively at acidic pH, we hypothesized that VISTA-mediated suppression of anti-tumor responses occurs predominantly within the tumor beds themselves. We tested the activity of the acidic pH-selective human VISTA blocking antibody P1-068767 ('767) and its non-pH-selective parent antibody P1-061029 ('029) in transgenic mice expressing the human VISTA extracellular domain in place of the endogenous VISTA extracellular domain (human VISTA knock-in mice, genOway).

Consistent with the combination and VISTA knockout experiments described above, P1-061029 and P1-068767 elicited comparable efficacy in combination with a mouse PD-1 blocking antibody (FIG. 15J-M).

Figure 15N:
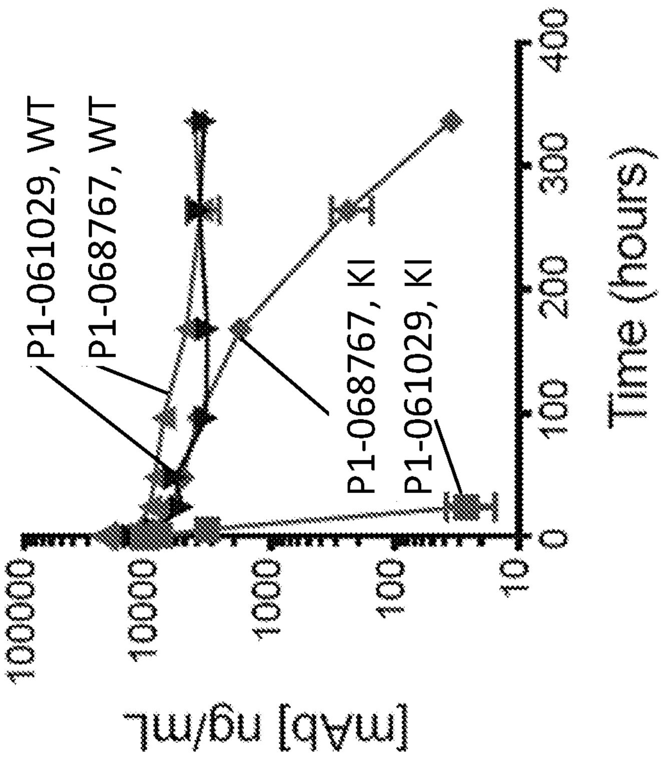
FIG. 15N shows human VISTA KI and wildtype littermate (WT) mouse serum antibody concentrations after intravenous injection of 5 mg/kg of P1-061029 (WT, downward triangles; KI, squares) or P1-068767 (WT, upward triangles; KI, diamonds). The calculated serum mean residence times (MRT) for P1-061029 and P1-068767 in KI mice are estimated to be 4.1 and 71 hours respectively. n=4 KI mice and 1-2 WT mice per antibody. These data are representative of a single experiment.
Figure 15O:
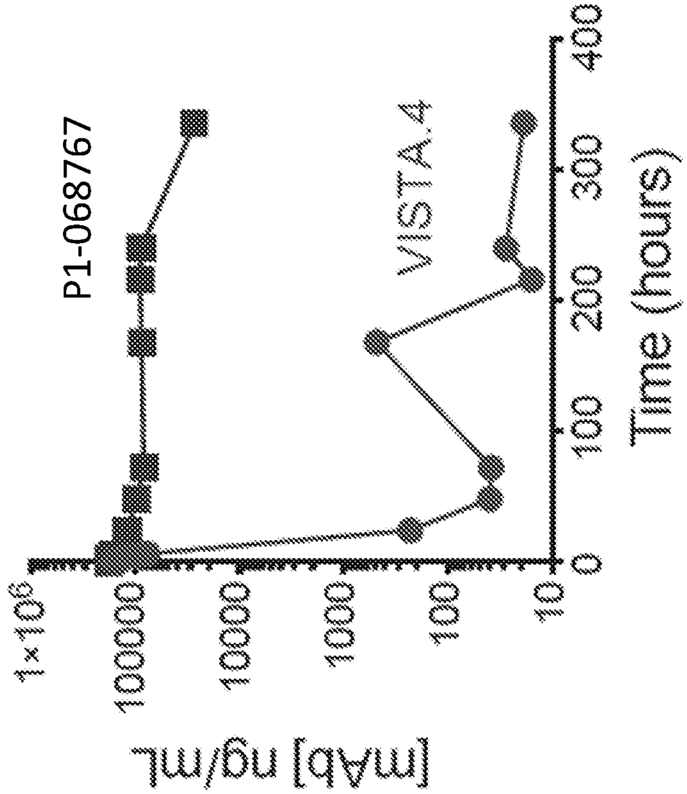
Figures 16A, 16B, 16C:
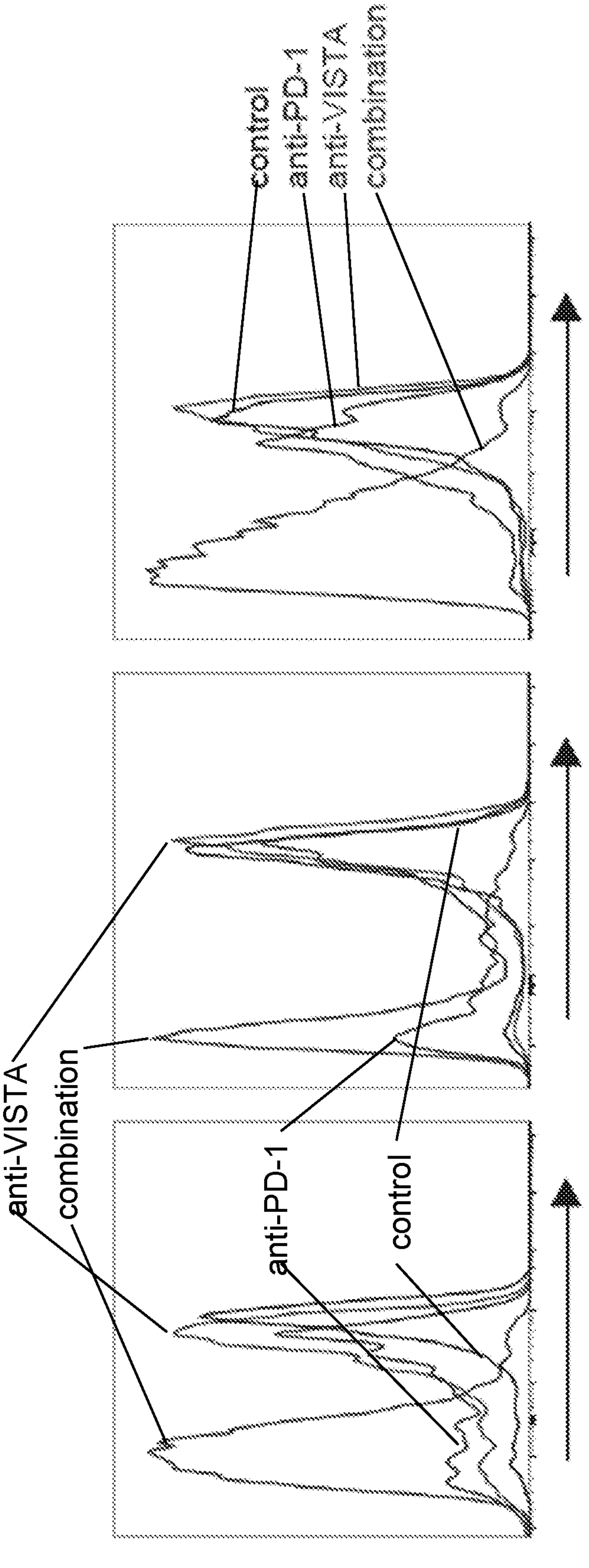
FIGS. 16A-C show representative histograms of intratumoral CD8+ T cell expression of PD-1 (FIG. 16A), LAG-3 (FIG. 16B), and TIM-3 (FIG. 16C) 7 days after the start of treatment. Error bars depict the standard error of the mean.

The half-life of P1-068767 and P1-061029 in the human VISTA knock-in mice was measured. As shown in FIG. 15N, P1-068767 exhibited a nearly 20-fold longer mean residence time (MRT) than did P1-061029, indicative of weak binding to VISTA at pH 7.4 and consequently reduced TMDD (71 hours and 4.1 hours respectively).

To assess antibody engagement of peripheral VISTA in a non-transgenic model, we treated cynomolgus macaques with P1-068767 and a neutral pH-preferring antibody called VISTA.4 (a separate patent application family to the same applicants provides further description of VISTA.4) as follows. VISTA.4 and P1-068767 were evaluated following 10 minute intravenous infusions into protein-naive cynomolgus monkeys at a dose of 5 mg/kg (n =1 per antibody). Serial blood samples were collected at 0.17, 0.5, 2, 4, 6, 24, 48, 72, 168, 216, 240, 336 hours post-infusion. Subsequently, serum samples were obtained for antibody concentration analysis using a ligand-binding assay that employed the recombinant VISTA as a capturing agent and an anti-human IgG Fc mAb as a detecting agent. The lower limit of quantification for the assay was 1 ng/mL. Mean residence times were estimated by non-compartment analysis of the serum mAb concentration-time data using Kinetica software (Version 5.0, Thermo Fisher Scientific). The results show that P1-068767 again exhibited a much longer MRT (717 hours and 7.6 hours respectively, FIG. 60). These results suggest that VISTA blockade in the tumor microenvironment, rather than in the blood and non-acidic tissues, drives anti-tumor efficacy.

Example 19: VISTA.4 Inhibits VISTA Binding to PSGL-1

Imunoreceptor P-selectin glycoprotein ligand-1 (PSGL-1) was identified previously as a VISTA ligand (see, WO2018132476). PSGL-1 is a receptor for selectins, particularly P-selectin, and binding to its primary ligand, P-selectin, is a well characterized facilitator of adhesion interactions between leukocytes, platelets, and endothelial cells (Carlow, D. A., et al., PSGL-1 function in immunity and steady state homeostasis. Immunol Rev, 2009. 230(1): p. 75-96, and Abadier, M. and K. Ley, P-selectin glycoprotein ligand-1 in T cells. Curr Opin Hematol, 2017. 24(3): p. 265-273. 18). PSGL-1 has also been identified as a negative regulator of T cell responses in contexts of chronic viral infection, cancer tumor immunity, and some autoimmune diseases (Angiari, S., et al., Regulatory T cells suppress the late phase of the immune response in lymph nodes through P-selectin glycoprotein ligand-1. J Immunol, 2013. 191(11): p. 5489-500; Matsumoto, M., M. Miyasaka, and T. Hirata, P-selectin glycoprotein ligand-1 negatively regulates T-cell immune responses. J Immunol, 2009. 183(11): p. 7204-11; Nunez-Andrade, N., et al., P-selectin glycoprotein ligand-1 modulates immune inflammatory responses in the enteric lamina propria. J Pathol, 2011. 224(2): p. 212-21; Perez-Frias, A., et al., Development of an autoimmune syndrome affecting the skin and internal organs in P-selectin glycoprotein ligand 1 leukocyte receptor-deficient mice. Arthritis Rheumatol, 2014. 66(11): p. 3178-89; Tinoco, R., et al., PSGL-1 Is an Immune Checkpoint Regulator that Promotes T Cell Exhaustion. Immunity, 2016. 44(5): p. 1190-203). This immunosuppressive function appears to be independent of known PSGL-1 ligands (Tinoco, R., et al., PSGL-1: A New Player in the Immune Checkpoint Landscape. Trends Immunol, 2017. 38(5): p. 323-335).

In cell-based assays, recombinant PSGL-1 and recombinant P-selectin were shown to both be capable of blocking of VISTA multimer binding to activated human CD4+ T cells. Deletion of PSGL-1 from activated CD4+ T cells by CRISPR also ablated VISTA multimer binding. In addition, ectopic expression of PSGL-1 was shown to be sufficient to enable VISTA binding to CHO cells at acidic pH, and VISTA expression was sufficient to enable PSGL-1 binding to 293T cells at acidic pH.

Figure 17A:
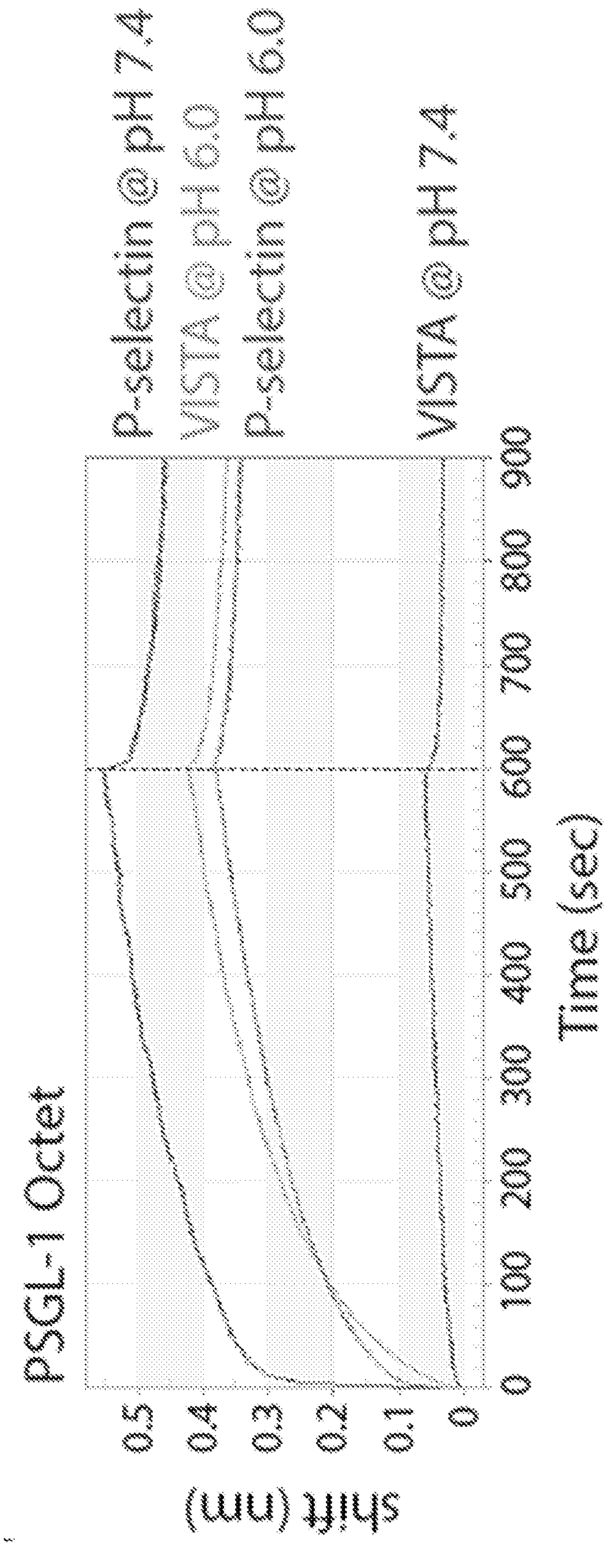
FIGS. 17A-C show that VISTA binds to PSGL-1 at acidic pH and that this interaction is blocked by VISTA antibodies P1-061029, P1-068761, P1-068767 and VISTA.4.

This Example shows that PSGL-1 bound P-selectin comparably at acidic and physiological pH, but bound VISTA only at acidic pH (FIG. 17A). The experiment was conducted using Octet biosensor assays with VISTA, P-selectin, and the minimal PSGL-1 glycopeptide (amino acids 1-19, with both sulfotyrosine and siayl lewis X carbohydrate post-translational modifications) previously shown to support high affinity P-selectin binding (Sako, D., et al., A sulfated peptide segment at the amino terminus of PSGL-1 is critical for P-selectin binding. Cell, 1995. 83(2): p. 323-319).

Figure 25A:
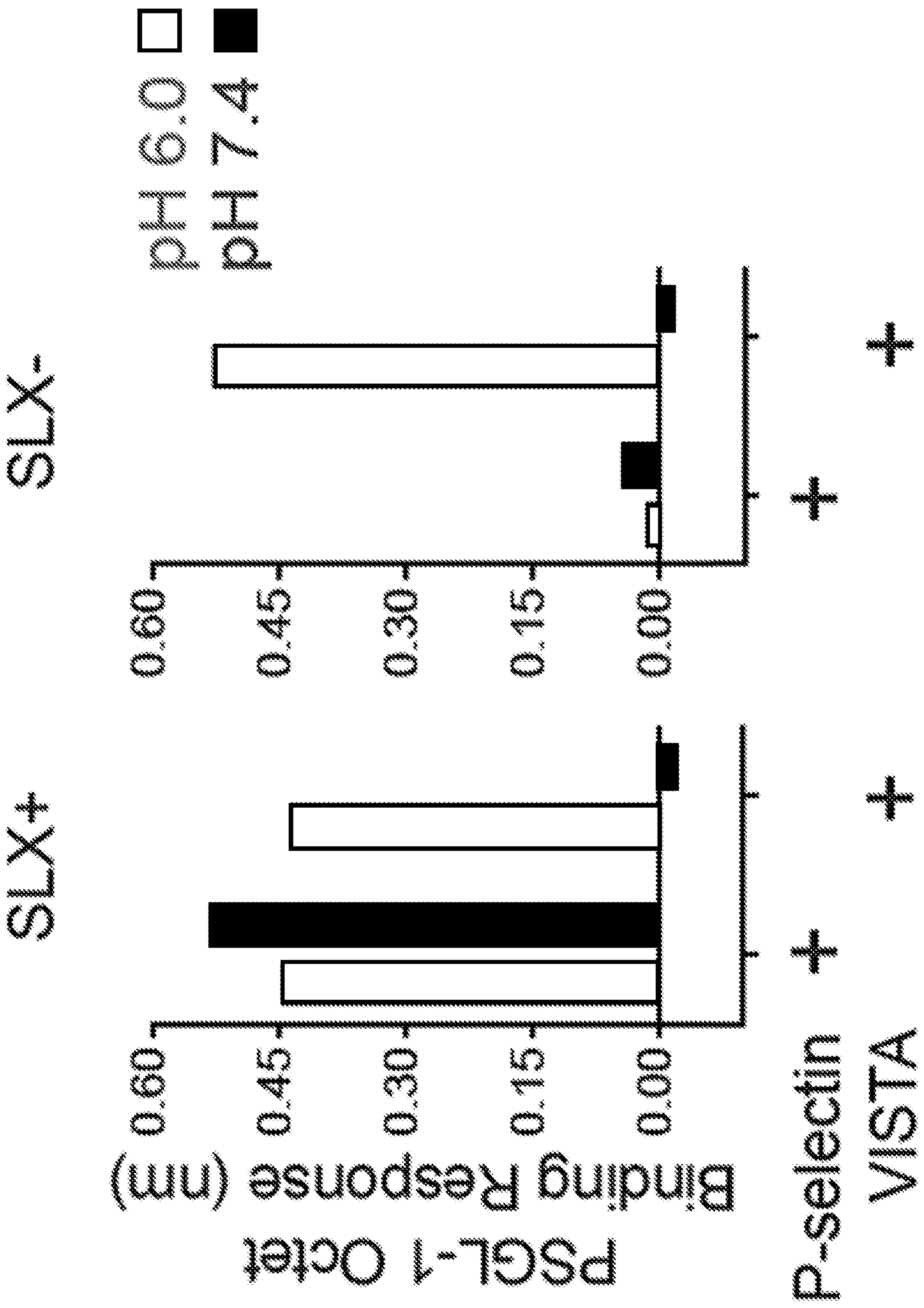
FIGS. 25A-E show that VISTA: PSGL-1 binding specificity is determined by histidine and sulfotyrosine residues.

PSGL-1's ligand interface relies on negatively charged sulfotyrosine and siayl Lewis-X post-translational modifications to bind P-selectin with high affinity (Sako et al. 1995 Cell 83(2): p. 323-319), and naïve T cells, which express non-siayl-lewis-X decorated PSGL-1, are consequently unable to engage P-selectin efficiently. Siayl lewis X-decorated PSGL-1 is constitutively expressed on circulating monocytes and neutrophils, and inducibly expressed on activated T cells, consistent with strong VISTA binding to these cell types at acidic pH. However, VISTA was found to bind to both naïve and activated T cells, suggesting that unlike P-selectin, VISTA binds PSGL-1 independently of siayl lewis X. In additional Octet biosensor assays, it was found that, while VISTA and P-selectin both bound preferentially to PSGL-1 glycopeptides with siayl lewis X decoration, only VISTA bound PSGL-1 glycopeptides without siayl lewis X. In addition, PSGL-1 produced in cells not expressing the enzymes glucosaminyl (N-acetyl) transferase (GCNT1) and alpha (1,3)-fucosyltransferase-7 enzymes (FUT7) lacked sialyl lewis X decoration and bound poorly to P-selectin (FIG. 25A). In contrast, VISTA bound PSGL-1 independently of sialyl lewis X (FIG. 25A). This result is consistent with VISTA, but not P-selectin, binding to naïve T cells which lack sialyl lewis X.

Also similar to P-selectin, VISTA bound modestly to heparan sulfate at acidic pH.

Additionally, PSGL-1 antibodies that block P-selectin binding did not block VISTA binding. These data indicate that VISTA binds a PSGL-1 interface that is similar but distinct from that bound by P-selectin.

This Example further shows that antibodies P1-061029, P1-068761, P1-068767 and VISTA.4, which block VISTA binding to T cells, also blocked VISTA binding to the PSGL-1 glycopeptide.

Figure 17B:
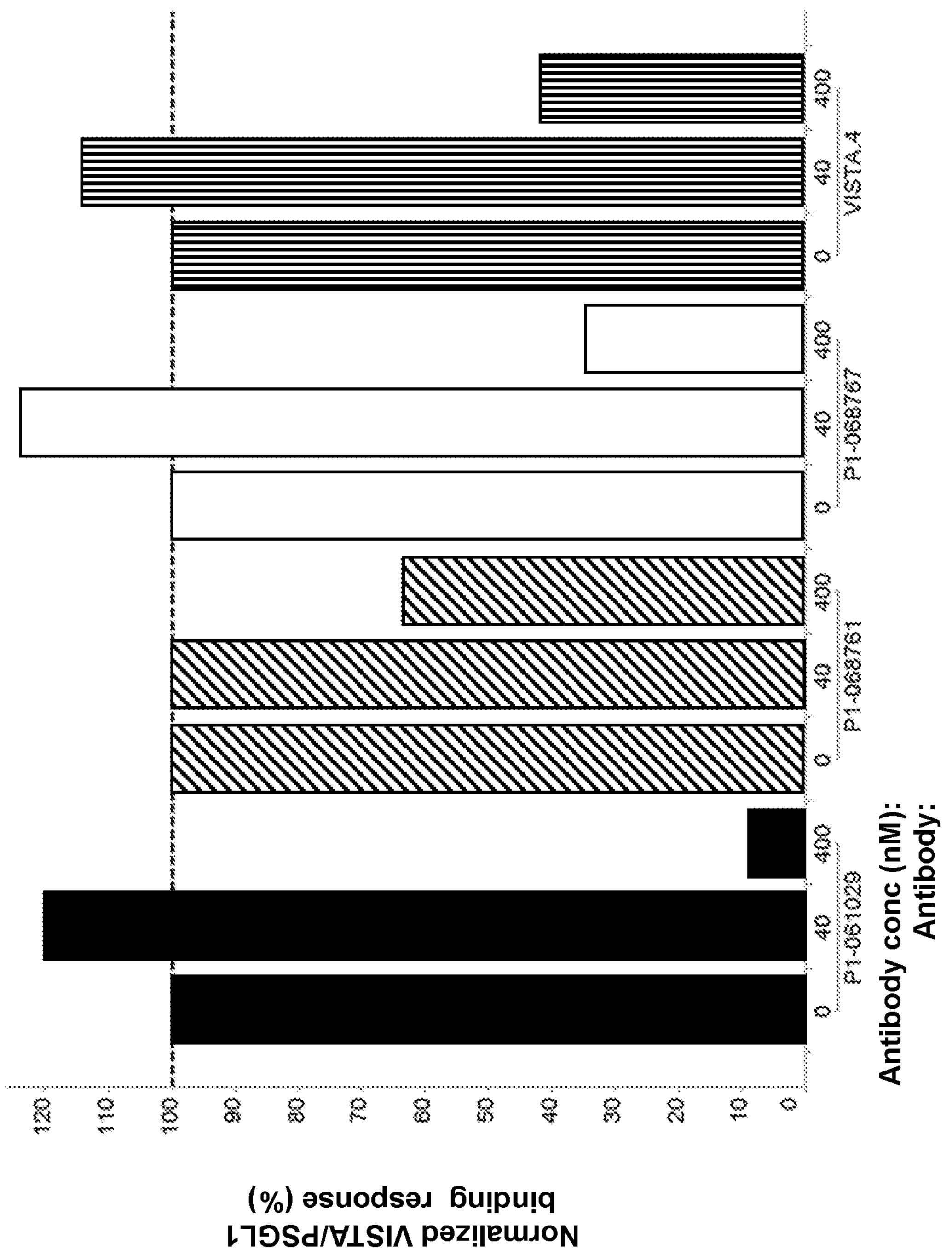

Competitive Octet assays were conducted to evaluate whether acidic pH-selective α-VISTA antibodies P1-068761 and P1-068767, the P1-061029 pH-independent parent, and acidic pH-sensitive VISTA.4 blocked VISTA binding to PSGL1. Binding assays were performed on an OctetRed384 bio-layer interferometry (BLI) instrument (PALL/ForteBio). All assay steps were performed at 30° C. at 1000 rpm shake speed, and the buffer used was PBST, pH 6.0 (137 mM sodium chloride, 2.7 mM potassium chloride, 10 mM phosphate buffer, 0.05% Tween 20). Human VISTA-Fc (R&D Systems #7126-B7) was diluted to 400 nM in PBST pH 6.0 and premixed for 30 minutes with a 0 nM, 40 nM, and 400 nM titration series of P1-068761, P1-068767, P1-061029 and VISTA.4. The human PSGL1 19-mer-huFc protein, consisting of the amino-terminal 19 amino acids of mature PSGL1 fused to human Fc, was captured onto anti-human IgG-Fc sensors (AHC, PALL/ForteBio). The anti-human capture sensors were blocked next with total human IgG (Jackson #009-000-002). Binding of the captured PSGL1 to VISTA-Fc/α-VISTA antibody mixture was measured next to assess whether the α-VISTA antibodies prevented VISTA from binding to PSGL1. For each antibody titration series, the magnitude of VISTA binding to PSGL1 (nm shift) was normalized to the 0 nM unblocked VISTA: PSGL 1 response, set at 100%. The results from this assay are summarized in FIG. 17B. In this assay, the 400 nM concentrations of P1-061029, P1-068761, P1-068767 and VISTA.4 all demonstrated blocking activity. The VISTA-Fc protein was prevented from binding to the captured human PSGL1-19-mer-huFc protein, as indicated by the reduced VISTA binding observed.

Figure 17C:
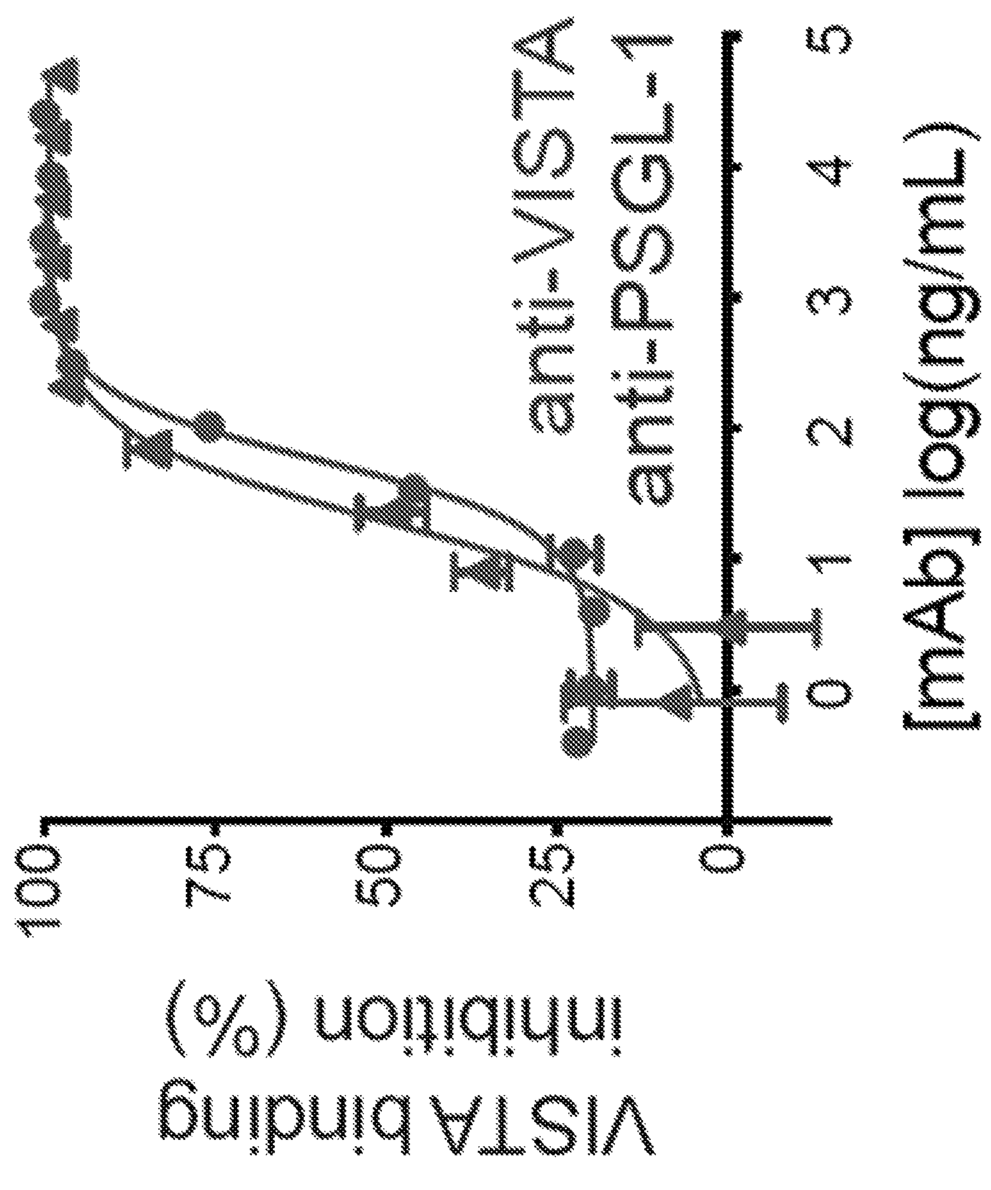

Additionally, it was demonstrated that VISTA binding to CHO-PSGL-1 cells was blocked by both VISTA.4 and the P-selectin-blocking PSGL-1 antibody KPL-1 (FIG. 17C). In PSGL-1 antibody blocking assays, the cells were pre-incubated with KPL-1 (BD Biosciences or Biolegend) or PL2 (MBL) the indicated antibodies prior to labeling with 32 nM-loaded VISTA multimers or VISTA-Fc chimeric proteins. VISTA-Fc binding was detected by anti-IgG (Jackson ImmunoResearch) or anti-6×his (Columbia Biosciences) antibodies. Cells were acquired by flow cytometry or homogenous time resolved fluorescence (HTRF).

Example 20: Crystal Structure of P1-068767 Bound to h VISTA

Figure 18A:
FIGS. 18A-E show representations of the co-crystal structure of P1-068767 Fab and hVISTA, or (in FIG. 18E) non-blocking antibody VISTA.5 and hVISTA. The VISTA IgV domain features an unusual, histidine-rich extension of its central β-sheet. The VISTA IgV domain was co-crystallized with the P1-068767 Fragment antigen-binding (Fab). The crystal structure of the VISTA+P1-068767 complex was determined at 1.6 Å resolution.
Figure 18B:
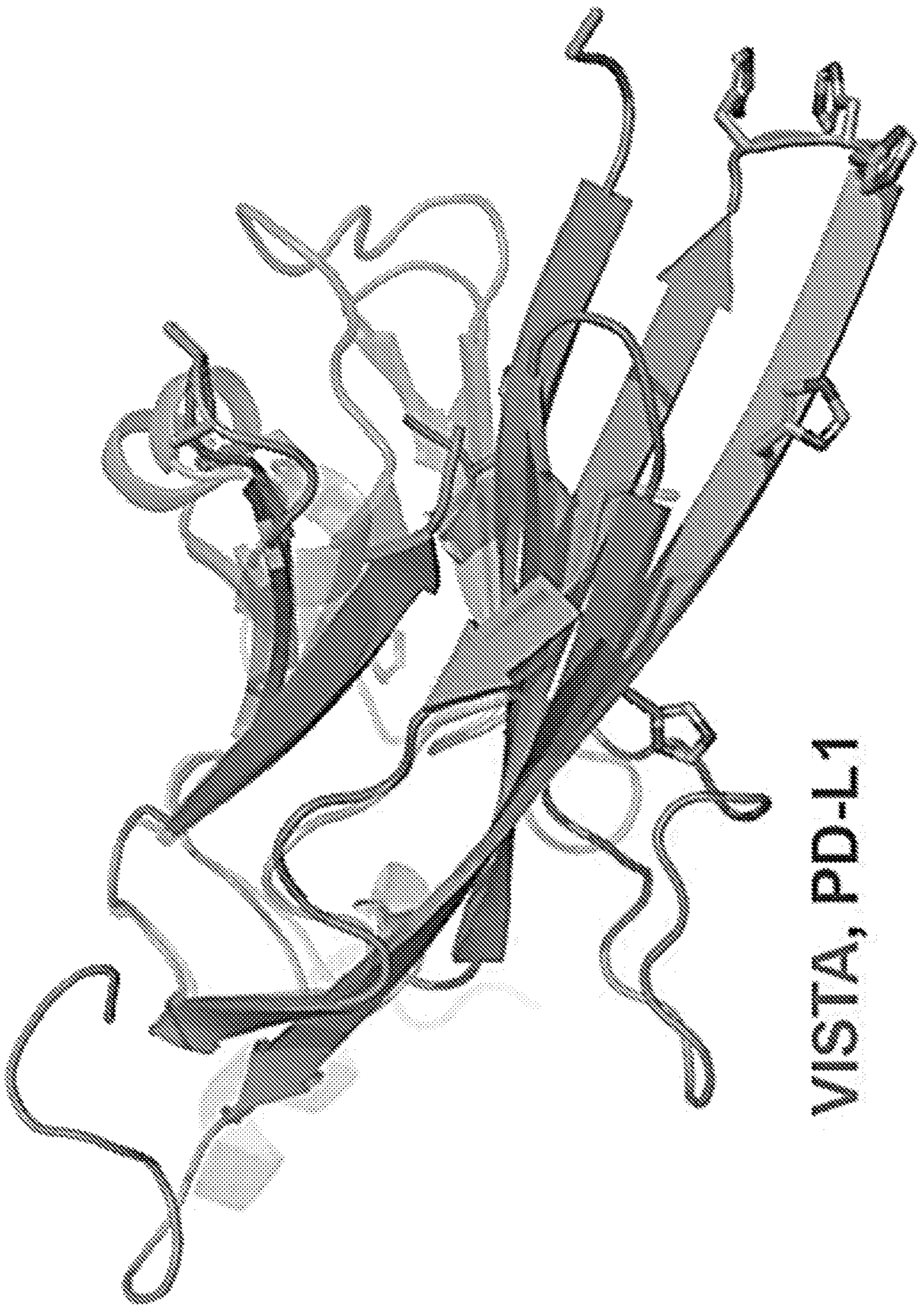
Figure 18C:
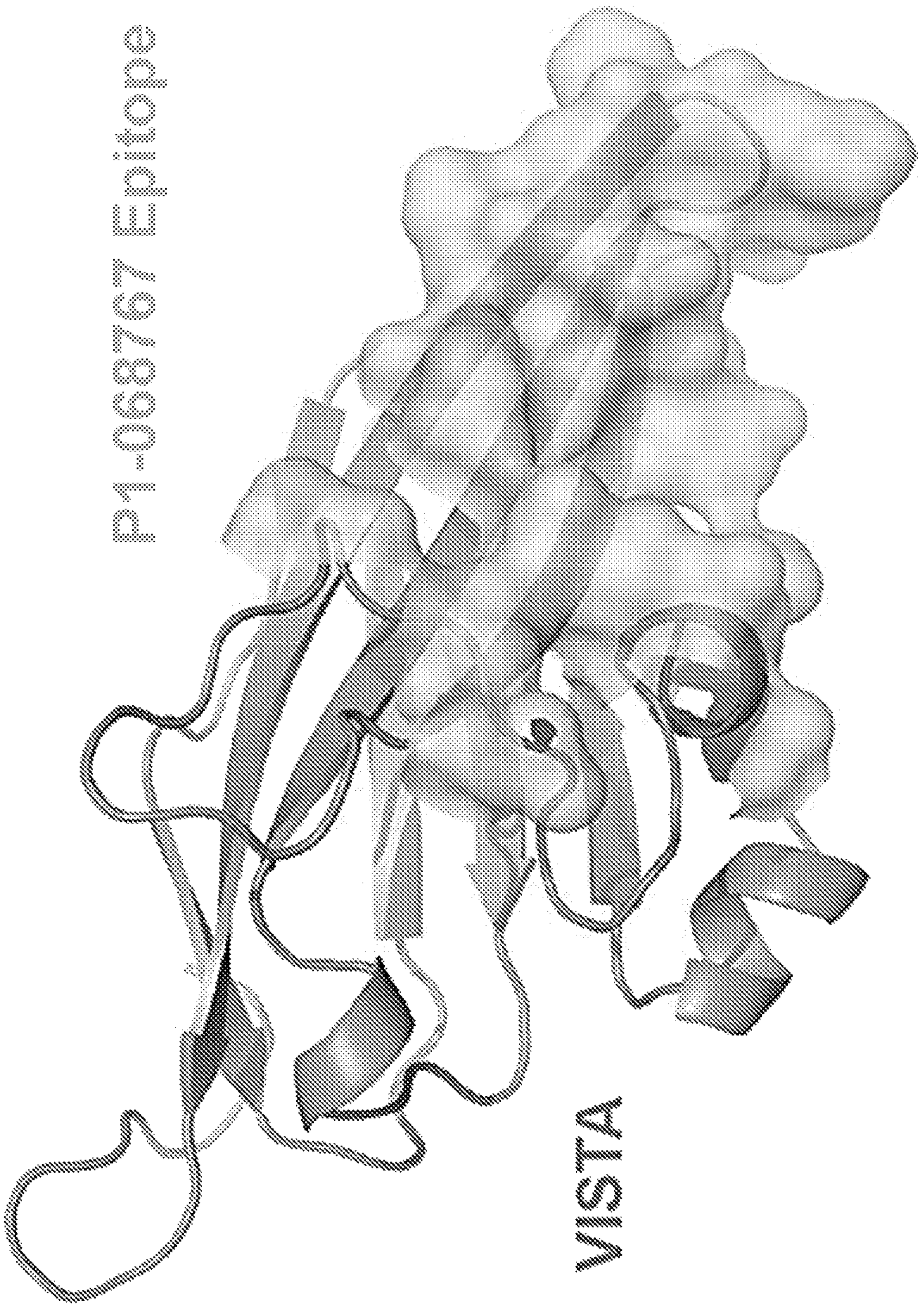
Figure 18D:
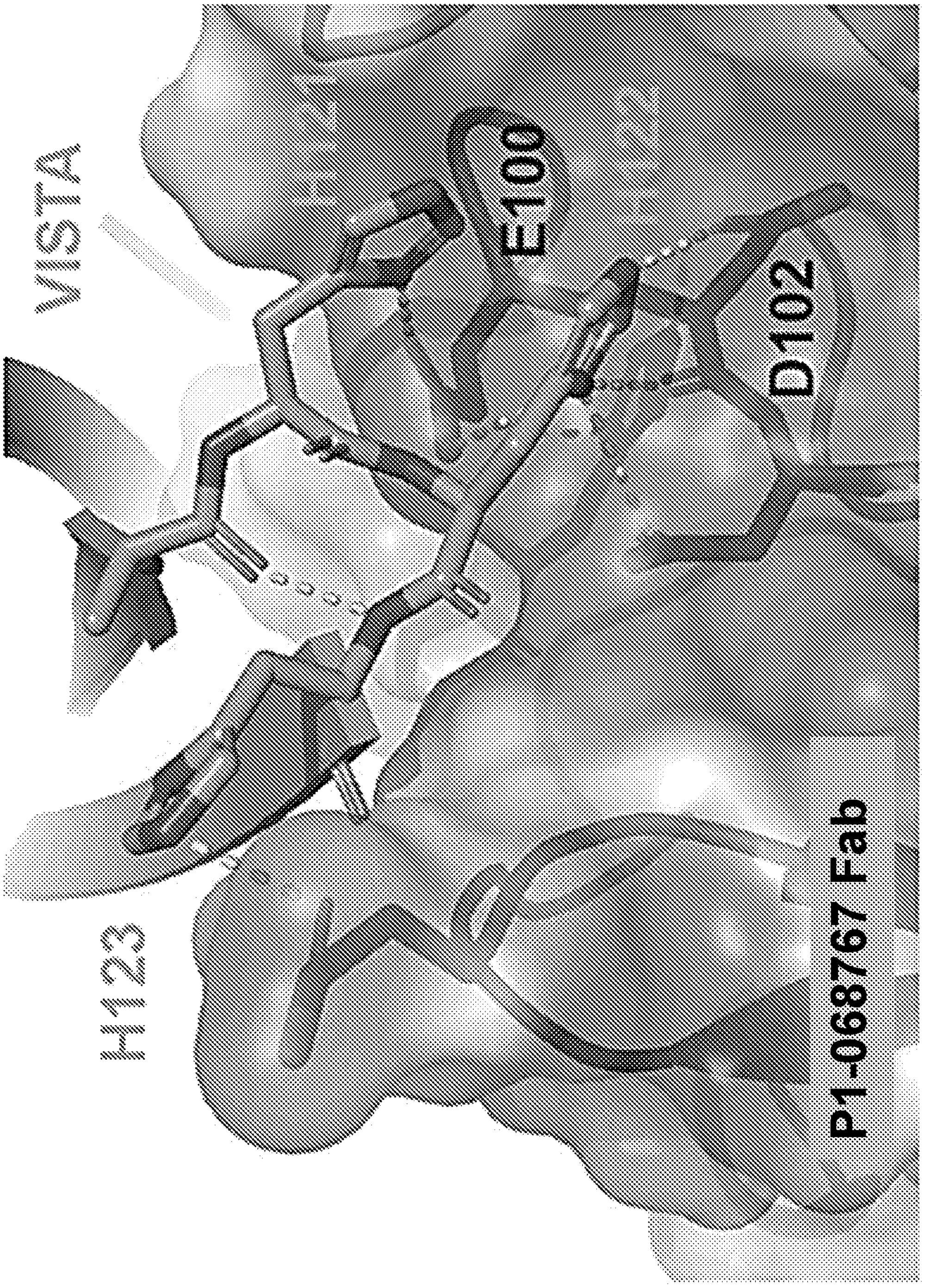
Figure 18E:
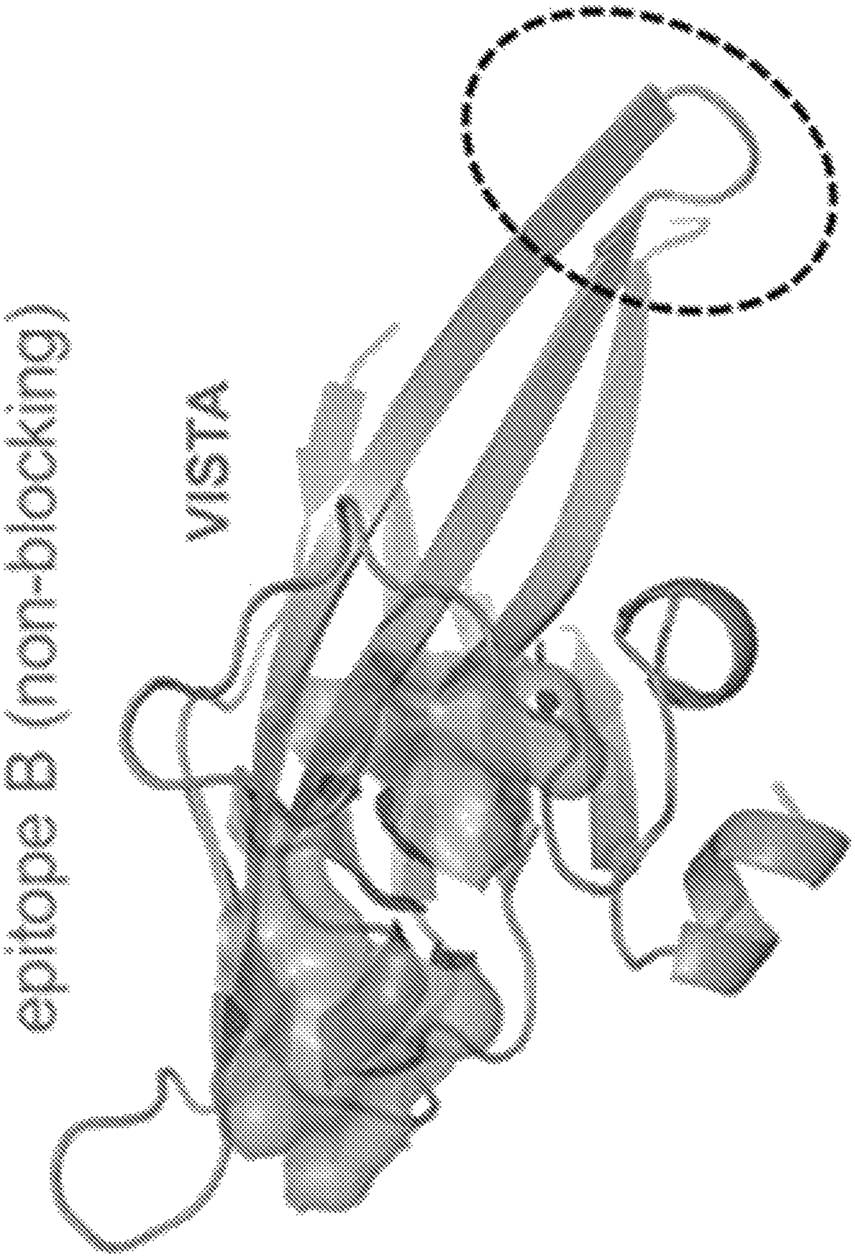

To characterize VISTA's structure and the molecular determinants of VISTA antibody binding, a co-crystal of the hVISTA IgV domain with the P1-068767 Fragment antigen-binding (Fab) was made. The structure of the resulting complex was determined at 1.6 Å resolution (FIG. 18). The VISTA IgV domain is generally characteristic of its family, with some resemblance to PD-L1 (FIG. 18B). However, unlike PD-L1 and most other B7 family or immunoglobulin superfamily members, the VISTA IgV domain's two C-terminal β-strands contain multiple additional residues, resulting in an unusually elongated and histidine-rich central β-sheet (FIG. 18B). P1-068767, a blocking antibody, binds VISTA at this β-sheet extension (FIG. 18C), while the non-blocking antibody VISTA.5 binds a different region (FIG. 18E). VISTA's β-sheet extension is capped by three histidine residues: H121, H122, and H123. P1-068767 residues E110 and D112 form hydrogen bonds with VISTA residues H121 and H122 respectively (FIG. 18D). These interactions fit well with the findings described in previous Examples that P1-068767 residues E110 and D112 are necessary and sufficient for acidic pH-selectivity. In the cocrystal, VISTA residue H123 interacts with a sulfate molecule from the precipitant and forms a salt bridge with P1-068767 residue E1; though it is possible that VISTA H123 can form a bona fide hydrogen bond with P1-068767 in the absence of sulfate (FIG. 18D). Additional interactions are provided in Table 13. These data suggest that the VISTA IgV domain's unusual, histidine-rich β-sheet extension is a key component of VISTA's acidic pH-selective receptor-ligand interface.

TABLE 20 details the distances in Ångströms (Å), between '767 Fab HC atoms within 4 Å of VISTA atoms.

| # # | '767 Fab HC | | Dist. 1 | VISTA |
|---|---|---|---|---|
| 1 | H:GLU | 1 [ OE1 ] | 3.1 | V:HIS 123 [[ NE2 ] |
| 2 | H:VAL | 2 [ N ] | 3.2 | V:HIS 123 [ O ] |
| 3 | H:GLY | 26 [ O ] | 3.1 | V:GLU 125 [ N ] |
| 4 | H:GLU | 30 [ O ] | 3.3 | V:ARG 54 [ NH2 ] |
| 5 | H:GLU | 30 [ OE1 ] | 3.8 | V:ARG 127 [ NE ] |
| 6 | H:GLU | 30 [ OE1 ] | 3.2 | V:ARG 127 [ NH2 ] |
| 7 | H:GLU | 30 [ OE2 ] | 3.4 | V:ARG 127 [ NH1 ] |
| 8 | H:GLU | 30 [ OE2 ] | 3.5 | V:ARG 127 [ NH2 ] |
| 9 | H:ASP | 31 [ OD1 ] | 2.8 | V:ARG 54 [ NH1 ] |
| 10 | H:ASP | 31 [ OD1 ] | 2.7 | V:ARG 54 [ NH2 ] |
| 11 | H:ASP | 31 [ OD1 ] | 2.8 | V:ARG 127 [ NH1 ] |
| 12 | H:ASP | 31 [ OD2 ] | 3.8 | V:ARG 127 [ NE ] |
| 13 | H:ASP | 31 [ OD2 ] | 3.1 | V:ARG 127 [ NH1 ] |
| 14 | H:TYR | 32 [ OH ] | 2.6 | V:GLU 125 [ OE1 ] |
| 15 | H:GLU | 110 [ OE2 ] | 2.8 | V:HIS 122 [ N ] |
| 16 | H:GLU | 110 [ OE1 ] | 2.7 | V:HIS 121 [ ND1 ] |
| 17 | H:GLU | 110 [ OE2 ] | 3.8 | V:HIS 121 [ ND1 ] |
| 18 | H:GLU | 110 [ OE2 ] | 3.5 | V:HIS 122 [ ND1 ] |
| 19 | H:ASP | 111 [ OD1 ] | 3.6 | V:HIS 122 [ NE2 ] |
| 20 | H:ASP | 112 [ OD1 ] | 3.5 | V:HIS 122 [ ND1 ] |

Example 21: Epitope Mapping

The hVISTA epitopes of '015, '029, '761 and '767, formatted as IgG1.3 antibodies, were previously determined by 2 different methods: BLI (bio-layer interferometry) competition and yeast surface display.

Competitive BLI epitope binning assays were conducted to evaluate whether acidic pH-selective VISTA antibodies P1-068761 and P1-068767 retained similar or overlapping epitopes on VISTA compared to the P1-061029 parent, P1-061015 and relevant VISTA control antibodies 1, 2 and 3. Sandwich and tandem format binning assays were performed on an OctetRed384 BLI instrument (PALL/ForteBio). All assay steps were performed at 30° C. at 1000 rpm shake speed, and the buffer used was acidic (pH 6.0) or neutral (pH 7.4) PBST (137 mM sodium chloride, 2.7 mM potassium chloride, 10 mM phosphate buffer, 0.05% Tween 20). For the sandwich format, anti-human IgG-Fc sensors (AHC, PALL/ForteBio) first captured the VISTA antibody panel at pH 7.4, then the anti-human capture sensors were blocked with total human IgG (Jackson #009-000-002). Human VISTA-ECD was captured next at pH 6.0, and finally competition for all possible antibody combinations was assessed at pH 6.0. In the tandem format assay, streptavidin-coated biosensors (SAX, PALL/ForteBio) first captured biotinylated h VISTA-ECD at pH 7.4, then the sensors captured the full VISTA antibody panel at pH 6.0, ensuring complete binding saturation of each antibody on VISTA before evaluating competition with all possible antibody combinations at pH 6.0.

Figure 11A:
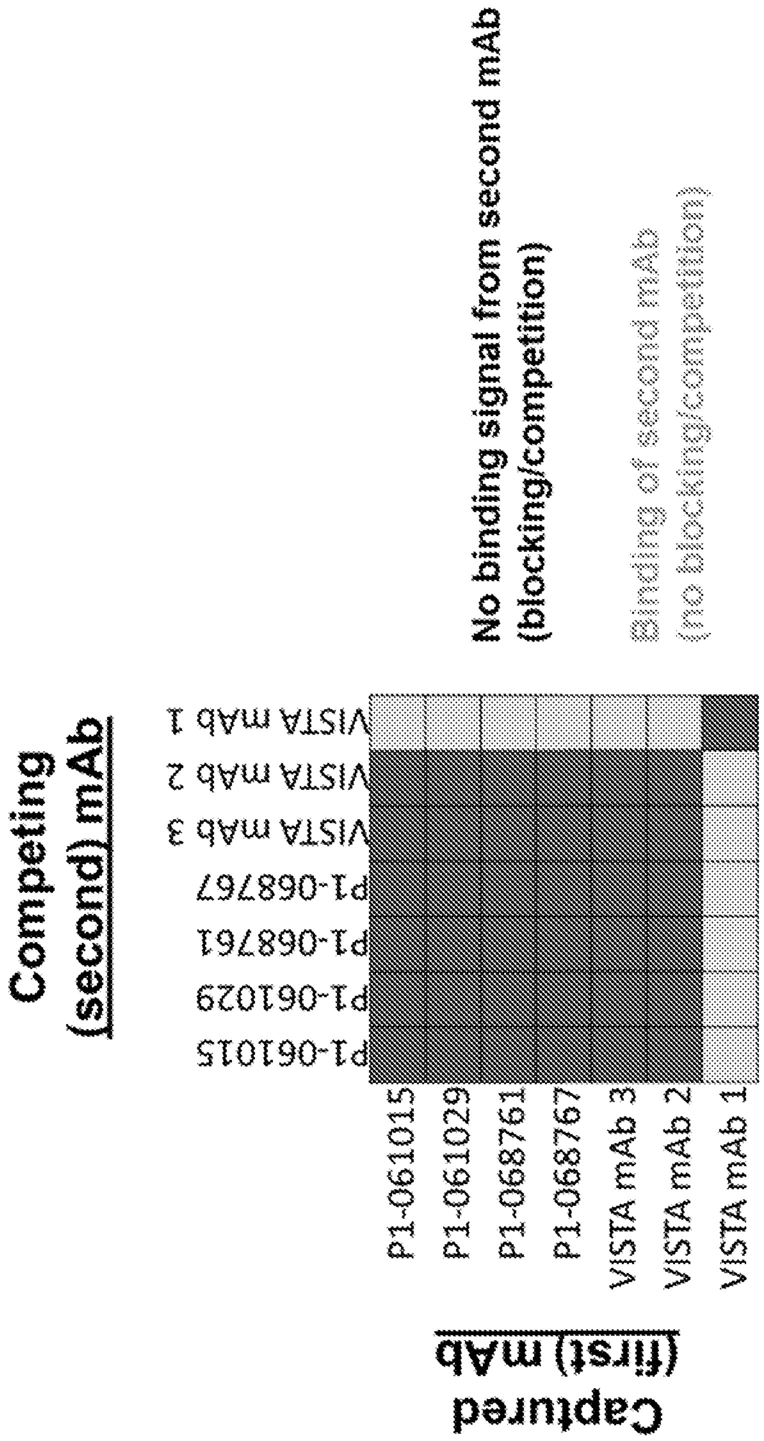
FIGS. 11A-C show epitope binning and mapping of various anti-VISTA antibodies.

The results of the Competitive BLI epitope binning assays are summarized by a competition matrix, FIG. 11A. In this figure, the first antibody captured is listed by row, and its binding or blocking activity to the (second) competitor antibodies are shown in each column. The competition matrix was identical for both assay formats. For the sandwich assay, binding (light gray) of the competitor antibody was defined by a signal ranging between 0.4-1.2 nm, and blocked antibodies (black) exhibited non-binding signal <0.1 nm. For the tandem assay, binding of the competitor antibody was defined by a signal ranging between 0.3-0.8 nm, and blocked antibodies exhibited non-binding signal <0.2 nm. While 'VISTA mAb 3' exhibited a fast acidic pH dissociation from hVISTA-ECD by SPR at 37° C. (FIG. 6C), it did not rapidly dissociate in either BLI assay format (conducted at 30° C.). These competitive assays indicated that P1-061015, P1-061029, acidic-pH selective antibodies P1-068761 and P1-068767 and VISTA antibodies 2 and 3 all compete with one another for similar or overlapping epitopes on VISTA. However, VISTA antibody 1 binds to a separate and distinct epitope. Thus, the charged amino acid mutations introduced to the VH CDRs of P1-061029 to generate the acidic-selective clones P1-068761 and P1-068767 have not significantly altered the VISTA binding epitope.

The epitopes of antibodies '029, '015, '761, and '767 were also mapped using yeast surface display and NGS according to the method of Chao et al. (2004) *J. Mol. Biol.* 342:539-550, Oliphant et al. (2006) *J. Virol.* 80:12149-12159, and Kowalsky et al. (2015) *J. Biol. Chem.* 290:26457-26470. Briefly, a saturation mutagenesis library of single point mutants of the VISTA ECD was generated and displayed on the surface of yeast. VISTA mutants that lost binding to the antibody being mapped but retained binding to a non-blocking antibody (mAb1) were sorted and sequenced. Since they retained binding to mAb1, these mutants were likely correctly folded, and the loss of binding seen to the antibody being mapped was likely due to the loss of an energetically important contact residue. The positions of these mutations were designated as energetically important residues in the antibody's epitope and are shown in Table 21 below.

TABLE 21

| Residues of huVISTA that are identified as epitope residues of anti-VISTA mAbs | | | | | | | | | | | | | | | | | | | | | | | | | | | |
|---|---|---|---|---|---|---|---|---|---|---|---|---|---|---|---|---|---|---|---|---|---|---|---|---|---|---|---|
| mAb | V 34 | T 35 | Y 37 | K 38 | T 39 | Y 41 | S 52 | R 54 | T 61 | F 62 | Q 63 | L 65 | H 66 | L 67 | H 68 | H 69 | F 97 | L 115 | V 117 | E 118 | I 119 | R 120 | H 121 | H 122 | S 124 | E 125 | R 127 |
| VISTA.4 | x | x | x | | x | x | x | x | | x | | x | x | | x | | | x | x | | x | x | x | x | x | x | |
| '015 | | | x | x | x | | | x | | x | x | x | x | | | | x | x | x | | x | | | | x | x | |
| '029 | | | | | x | x | | x | x | x | x | x | x | | x | x | | x | x | | x | | | | x | x | x |
| '761 | | x | x | | x | | | x | x | x | x | | x | x | x | x | | x | x | | x | | | | x | x | x |
| '767 | | | | | x | x | | x | x | x | x | x | x | | | | | x | x | | x | | x | x | x | x | x |

Table 22 includes detailed data from Table 21, and lists the amino acid residues of hVISTA that are likely to reduce binding of each antibody listed, based on residue frequency observed in the yeast surface display/NGS method

TABLE 22

| VISTA amino acid substitutions likely to reduce binding of the listed antibodies | | | | | | |
|---|---|---|---|---|---|---|
| | P1-061015 pH 6 | P1-061015 pH 7 | P1-061029 pH 6 | P1-061029 pH 7 | P1-068761 pH 6 | P1-068767 pH 6 |
| T35 | | | | | P, Y, W | |
| Y37 | P, G, A, S, T, K, R, H, N, D, E, Q | P, G, S, N, D, E Q | Y, S, T, V, L, I, M, K, R, N, D, Q | P, G, S, T, V, L, I, M, K, R, N, D, E, Q | P, G, A, S, T, V, L, I, M, K, R, N, D, E, Q | G, T, V, L, I, M, K, R, N, Q |
| K38 | P, G, A, S, V | | | | | |
| T39 | G, M, R, H, F, Y, W, N, D, E, Q | M, K, R, H, F, Y, W, D, E, Q | G, A, S, M, Y, W, N, D, E, Q | G, A, S, V, L, M, R, H, F, Y, W, N, D, E, Q | G, Y, D, E | G, A, S, H, Y, W, N, D, E, Q |
| Y41 | | | | A, S, T, I, M | | P, I, M, H |
| R54 | L, M, F, Y, E | M, E | P, A, T, V, I, M, F, Y, N, D, E, Q | P, G, A, S, T, V, L, I, M, H, F, Y, W, N, D, E, Q | A, T, V, L, I, M, K, F, Y, E, Q | P, A, S, T, V, L, I, M, F, Y, W, D, E, Q |
| T61 | | | G, L, R, H, F, Y, D, E, Q | V, L, K, R, H, F, Y | G, V, H, Y, D | L, R, H, F, Y, D, E |
| F62 | G, A, S, M, K, R, N, D, E, Q | G, K, R, D, E, Q | P, G, A, S, T, V, I, M, H, Y, W, D, E, Q | P, G, A, S, T, V, L, I, M, K, R, H, Y, W, N, D, E, Q | P, G, A, S, T, V, M, H, Y, W, D, E, Q | P, G, A, S, T, V, L, M, H, Y, W, N, D, E, Q |
| Q63 | G, R, W, D, E | W, D, E | G, A, S, T, V, K, R, H, Y, W, N, D, E | P, G, S, T, L, M, K, R, H, F, Y, W, N, D, E | G, S, T, K, H, Y, N, D, E | P, G, A, S, T, V, L, I, M, K, H, F, Y, W, N, D, E |
| L65 | P, G, A, S, T, K, R, H, W, N, D, E, Q | P, G, S, K, W, D, E, Q | G, T, Y, D, E, Q | P, G, A, S, T, H, Y, W, N, D, E, Q, | | P, G, S, H, D, E, Q |
| H66 | P, T, V, L, I, M, K, R, F, Y, W | P, T, V, L, I, M, K, R, F, Y, W | T, V, L, I, Y, D, E, Q | G, T, V, L, I, M, K, R, W, N, D, E, Q | T, I, K, W, D | T, V, I, K, W, D, E |

TABLE 22-continued

VISTA amino acid substitutions likely to reduce binding of the listed antibodies

| | P1-061015 pH 6 | P1-061015 pH 7 | P1-061029 pH 6 | P1-061029 pH 7 | P1-068761 pH 6 | P1-068767 pH 6 |
|---|---|---|---|---|---|---|
| L67 | | | | | G, A | |
| H68 | | | L, I, M, F, E | L, I, E | G, T, V, L, I, Y, W, D, E, Q | |
| F97 | G, D, E | | | | | |
| L115 | R, W | | A, T, K, N, Q | A, T, K, F, N, Q | A, T, M, K, F, N | A, T, K, F, N, Q |
| V117 | M, K, N, D | M, K, R, W, E | T, M, K, R, W, E | T, L, I, M, K, R, W, E | T, I, M, K, W | T, L, I, M, K, R, W, E |
| I119 | F, P | P, N | P, M, E | P, M, E | M, H | P, M, H, F, N, E |
| H121 | | | | | | V, E, Q |
| H122 | | | | | | P, Y, N, D |
| S124 | P, V, L, I, K, F, D, E | L, I, M, H, W, Q | L, I, M, H, W, Q | | L, I, M, Q | L, I, M |
| E125 | A, S, T, L, M, K, H, Y, D | A, T, V, I, M, K, H, F, Y, W, N, D | T, V, I, M, H, F, Y, W | G, T, K, H, Y, W, N, D | V, I, H, N | T, V, I, F, Y, W, N |
| R127 | | | S, V, M, H | P, S, V, M, K, H, N | P, V, M, N | P, S, V, M, H, N |

VISTA.4 was also used in the competitive BLI epitope binning assay previously described above. The results indicate that VISTA.4 competes for binding to human VISTA 5 with the antibodies described above P1-061015, P1-061029, P1-068761, and P1-068767, and thus belongs to the same epitope group as these antibodies (Group A). VISTA.4 does not compete for binding to human VISTA with VISTA mAb 1.

The epitope of VISTA.4 was also mapped using yeast surface display and NGS, as described above. VISTA mutants that lost binding to the antibody being mapped but retained binding to a non-blocking antibody (mAb1) were sorted and sequenced. Since they retained binding to mAb1, these mutants were likely correctly folded, and the loss of binding seen to the antibody being mapped was likely due to the loss of an energetically important contact residue. The positions of the mutations that resulted in loss of binding, and which were designated as energetically important residues in the antibody's epitope, and are shown in Table 16, along with the energetically important contact residues of antibodies P1-061015, P1-061029, P1-068761, and P1-068767 (also shown in Table 21 above).

Figure 11B:
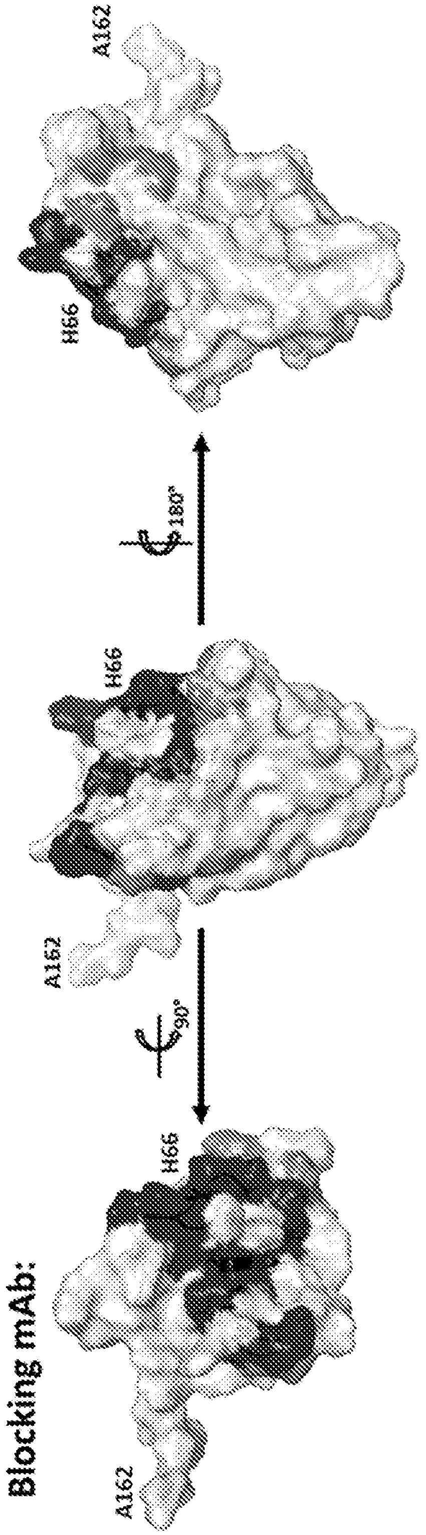
Figure 11C:
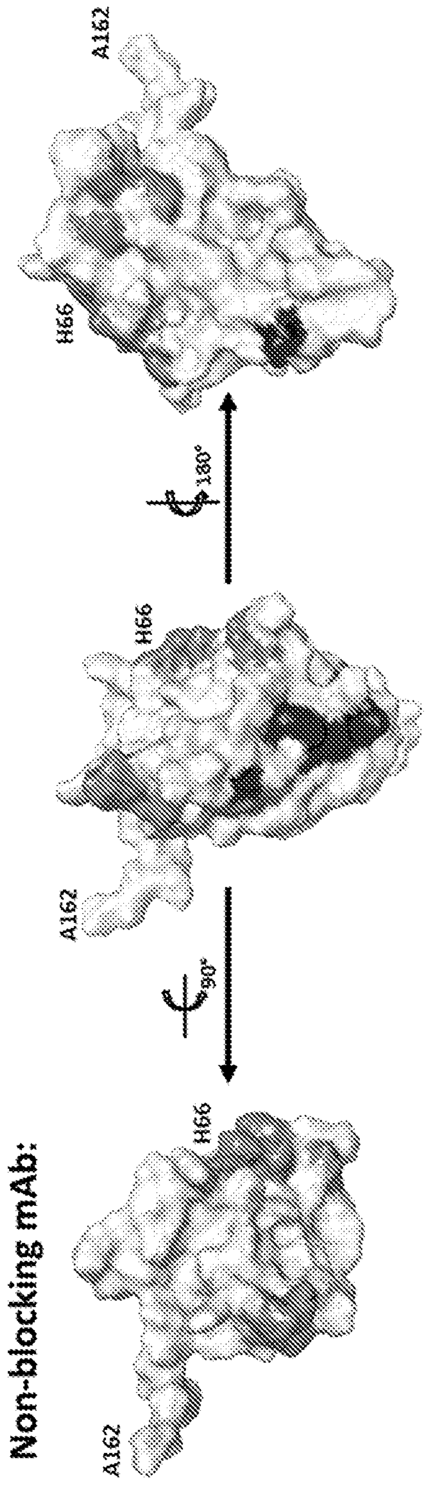

FIG. 11B and FIG. 11C show a representation of an epitope encompassing all the residues for blocking hVISTA antibody as listed in Table 21 (FIG. 11B) compared to the epitope of a non-blocking hVISTA antibody (mAb1; FIG. 11C). Amino acid residues 66 (H) and 162 (A) are indicated to denote the orientation of the molecule. Histidine residues are in grey, and epitope residues are in black. Notably, all blocking anti-VISTA mAbs occupy the same epitope region, in agreement with the octet binning data (showing that they competed with each other), with subtle residue differences among the queried antibodies. In contrast, the non-blocking hVISTA antibody (mAb1) occupies a distinct epitope region on the hVISTA molecule, and this is further supported by the octet binning data shows that none of the blocking mAbs competed with mAb1.

Example 22: VISTA.4 Inhibits VISTA Binding to T Cells at Acidic pH

Figure 21B:
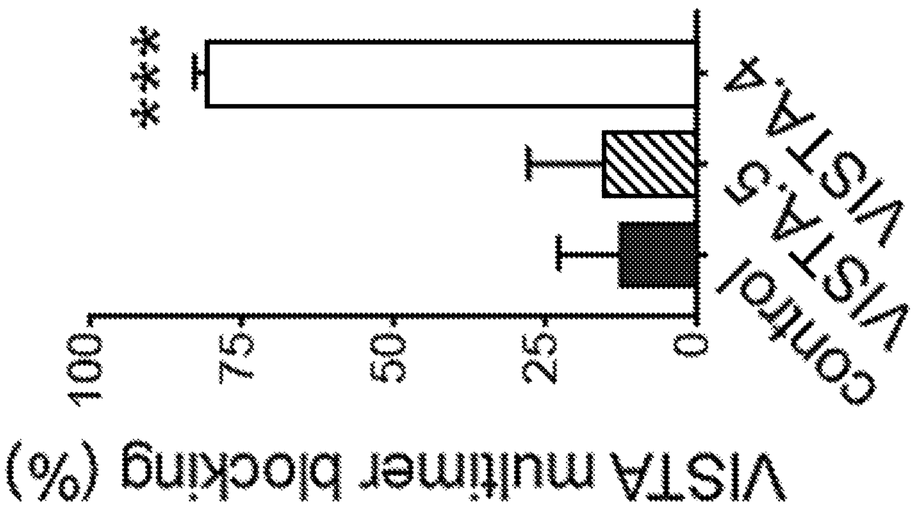
FIGS. 21A and 21B show VISTA multimer binding to activated human CD4+ T cells at pH 6.0 in the presence of the antibodies VISTA.4 (triangles), VISTA.5 (squares), and a non-VISTA-binding (control, circles).
Figure 21A:
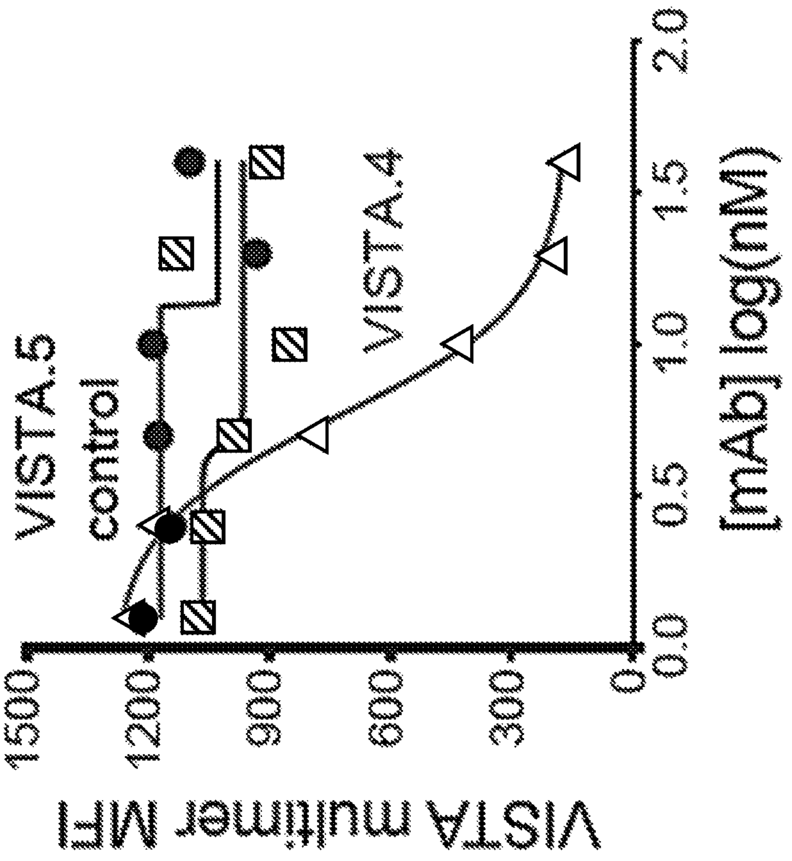

This Example shows that VISTA.4 and other antibodies in epitope group A blocked VISTA binding to T cells at acidic pH, whereas VISTA.5 (mAb1) and other antibodies in epitope group B did not (FIGS. 21A and B).

This example was conducted essentially as described in Example 4.

Example 23: VISTA.4 Enhances T Cell Proliferation and IFN-γ Production

Figure 22A:
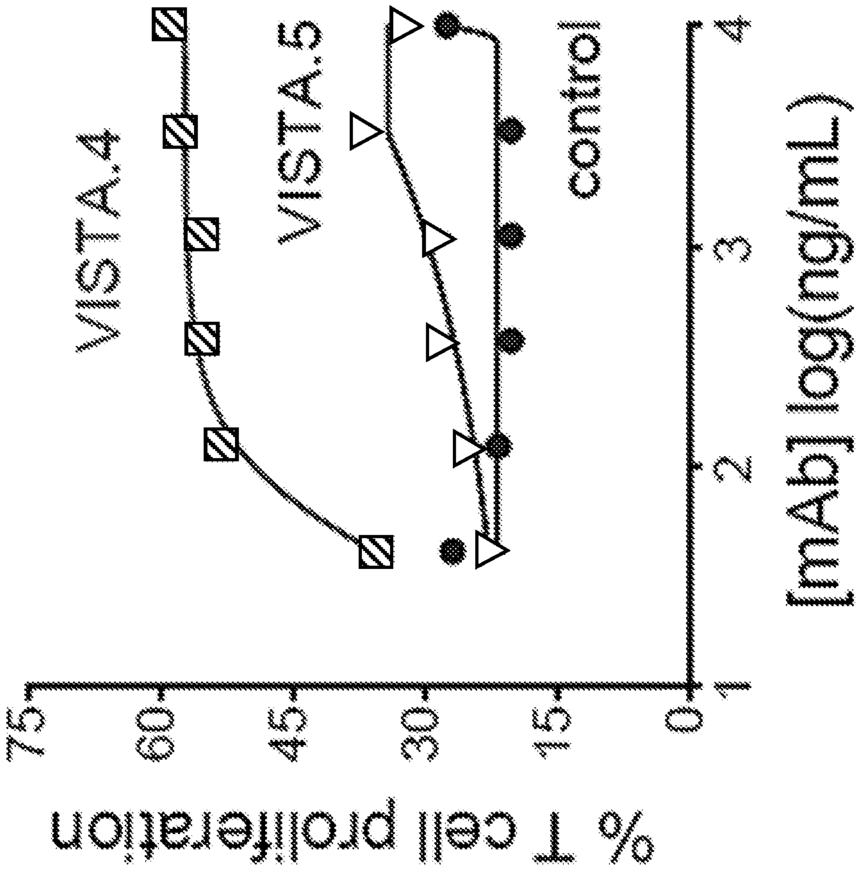
FIG. 22 shows that antibodies that block VISTA binding at acidic pH are functional. Effects of the blocking antibody VISTA.4 (squares), the non-blocking antibody VISTA.5 (triangles), and a non-VISTA-binding (control, circles) antibody on the proliferation (FIG. 22A) and interferon gamma production (FIG. 22B) of human CD4+ T cells co-cultured with 293T cells engineered to express VISTA and a TCR agonist (293T-OKT3-VISTA). One-way ANOVA with Dunnett's multiple comparisons, *, $P<0.05$. These data are representative of more than four independent experiments.
Figure 22B:
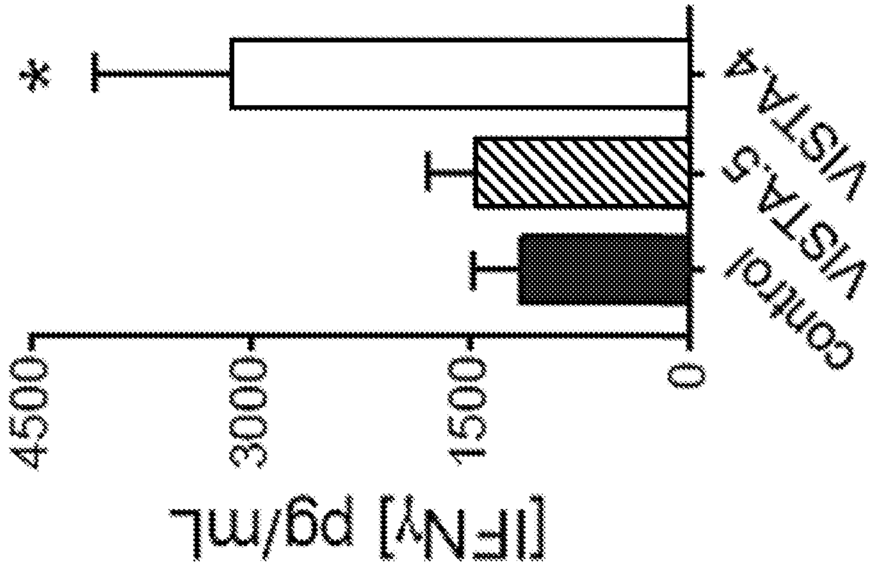

This Example shows that VISTA blocking Abs (epitope Group A) enhanced T cell proliferation and IFN-γ production (FIG. 22). VISTA.5 (mAb1), which is not a blocking antibody, did not enhance T cell proliferation or IFN-γ production. VISTA.4 had no effect when T cells were co-cultured with 293T-OKT3 cells that did not express VISTA.

This experiment was conducted by adding VISTA antibodies to CD4+ T cells co-cultured with 293T cells engineered to express human VISTA and a single chain variable fragment of the T cell receptor agonist antibody OKT3 (293T-OKT3-VISTA).

Example 24: VISTA Suppressed T Cell Receptor-Mediated NF-kB Signaling

Figure 23:
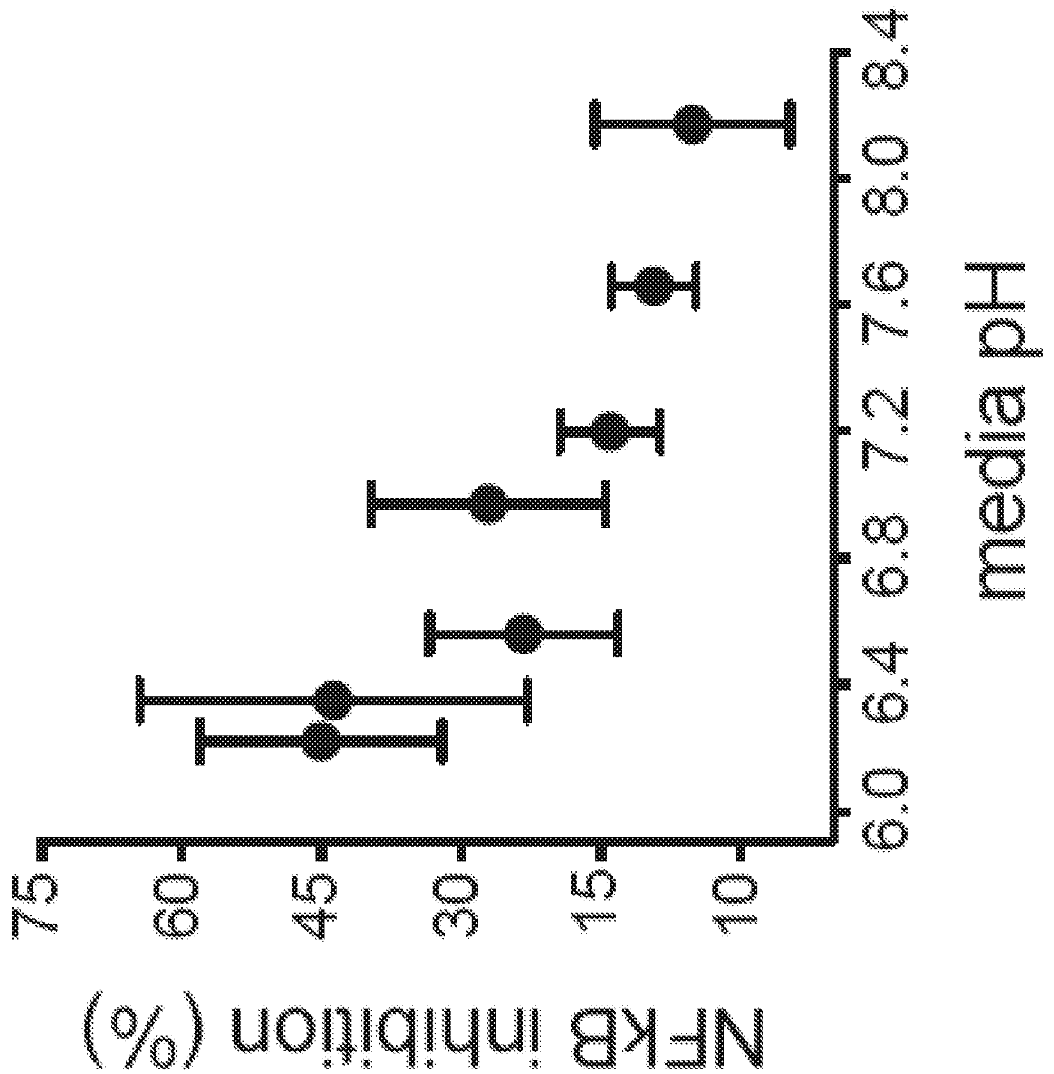
FIG. 23 shows the effects of VISTA.4 blockade on Jurkat T cell activation (by measurement of NF-kB inhibition) following co-culture with 293T-OKT3-VISTA cells at different pH. These data are representative of a composite of three independent experiments.
Figure 24:
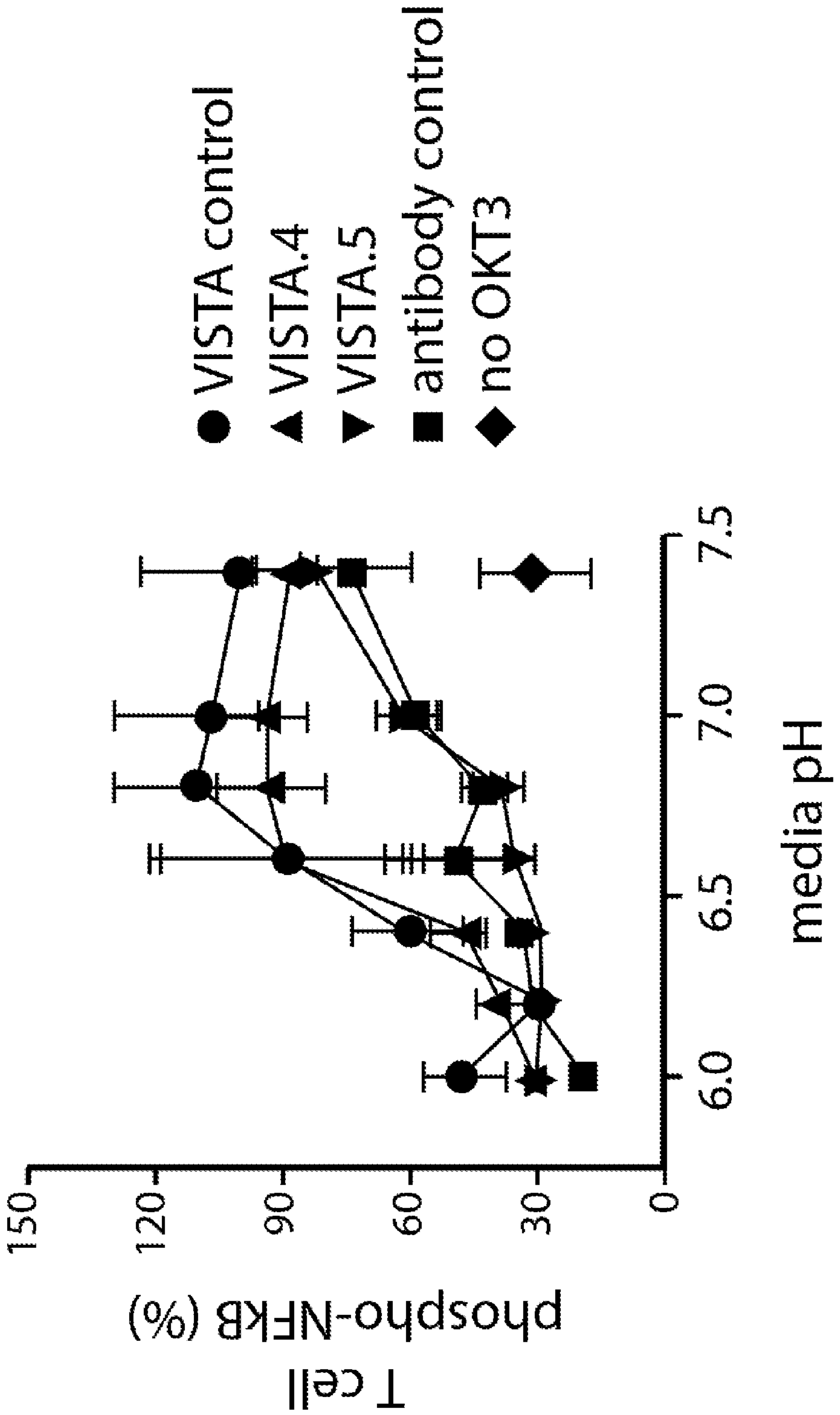
FIG. 24 shows effects of pH on VISTA suppression of human CD4+ T cells. Cells were stimulated at the indicated pH with plate coated OKT3 and VISTA-Fc in the presence of VISTA.4 (upward triangles), VISTA.5 (downward triangles), or a non-VISTA-binding antibody (antibody control, squares). Cells stimulated with plate-coated OKT3 and control IgG (VISTA control, black circles) or without OKT3 (no OKT3, grey diamond) are also shown. These data are representative of one independent experiment.

This Example was conducted to further assess the effects of pH on VISTA function, and shows that VISTA suppressed T cell receptor-mediated NF-kB signaling more potently at acidic pH than at neutral pH (FIG. 23A). Maximal suppression was reached below pH 6.5, similar to VISTA: T cell binding (FIG. 23A and FIG. 4A).

NF-kB signaling was measured using NFkB-reporting Jurkat T cells, essentially as described in Examples 5 and 13. Jurkat cells were engineered to express luciferase under the control of an NF-kB-inducible promoter. These Jurkat NFkB-luciferase cells were co-cultured with non-irradiated 293T-OKT3-VISTA cells at a ratio of 4:1 in HBSS (ThermoFisher) acidified to various pH with MES and human anti-human VISTA antibodies for 4 hours. Jurkat cell activation was measured by luciferase substrate assay (Promega). VISTA-mediated suppression was most potent at acidic pH, though a modest level of activity was maintained at pH 7.0 and above. Similarly, recombinant VISTA suppressed T cell NFkB phosphorylation at acidic pH more so than at pH 7.4 (FIG. 23B). These results indicate that VISTA suppresses T cells preferentially at acidic pH, and that this activity is reversed by antibodies that block T cell binding at acidic pH.

Thus, these data suggest that blockade of VISTA's acidic pH-selective receptor-ligand interface could reverse immunosuppression.

Figure 25B:
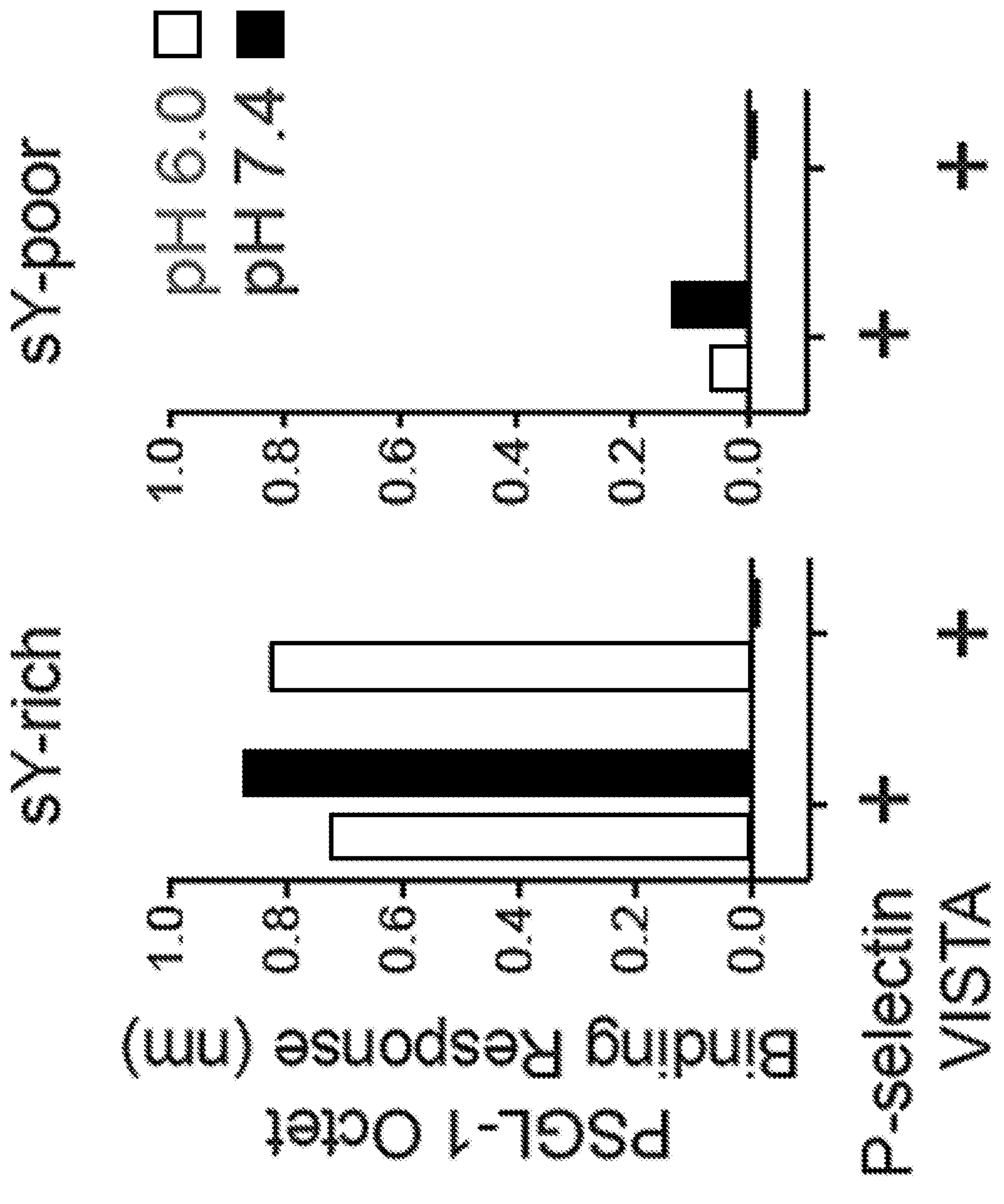

Example 25: VISTA: PSGL-1 Binding Specificity is Determined by Histidine and Sulfotyrosine Residues To characterize PSGL-1 binding specificity, in addition to that provided by sialyl lewis X, we examined tyrosine sulfation post-translational modifications that contribute to P-selectin binding. To test the role of tyrosine sulfation, PSGL-1 glycopeptides were fractioned into sulfotyrosine-rich (>90%) and sulfotyrosine-poor (<1%) peaks by anion exchange liquid chromatography. Neither VISTA nor P-selectin bound detectably to sulfotyrosine-poor PSGL-1 (FIG. 25B). VISTA was also unable to bind PSGL-1 glycopeptides in which tyrosines were substituted with alanines (not shown in figures). These results indicate that sulfotyrosine residues are key mediators of PSGL-1 binding to VISTA.

Figure 25C:
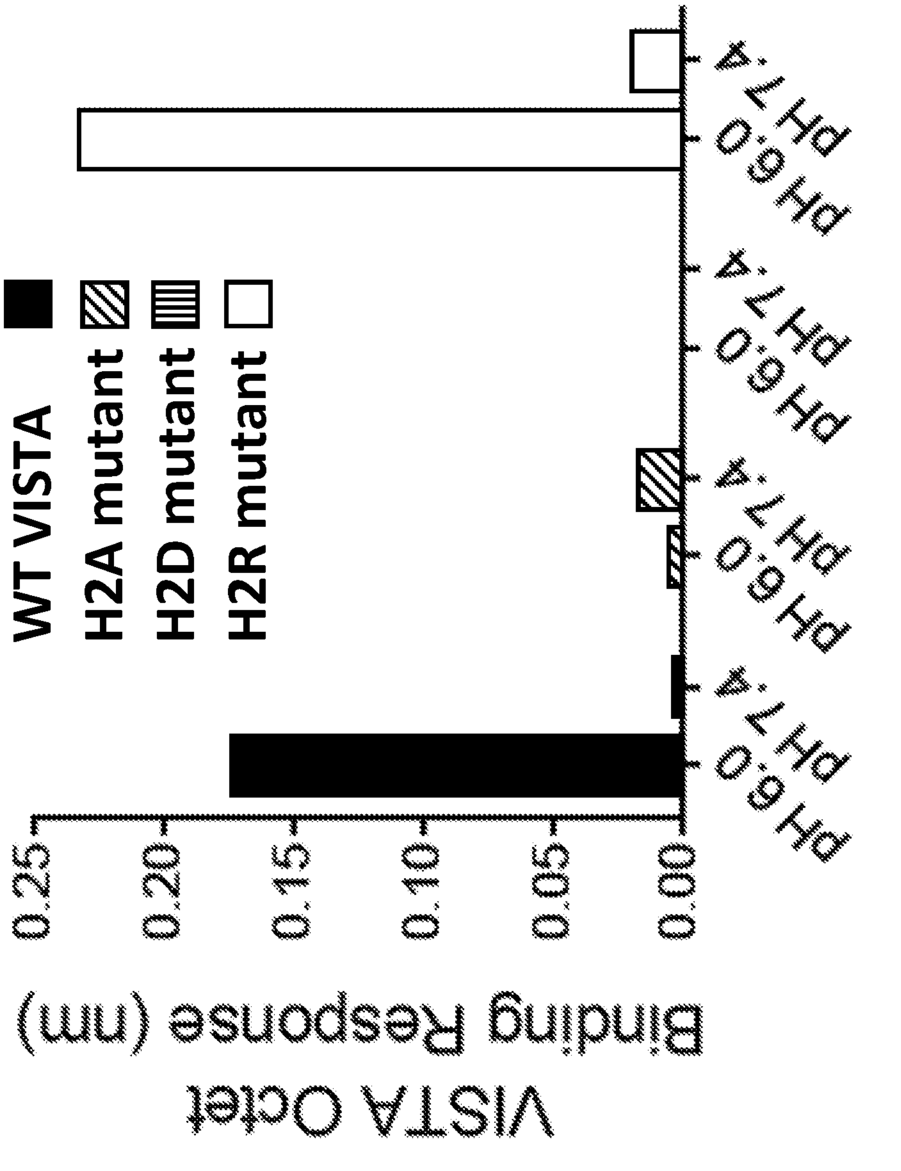
Figure 25D:
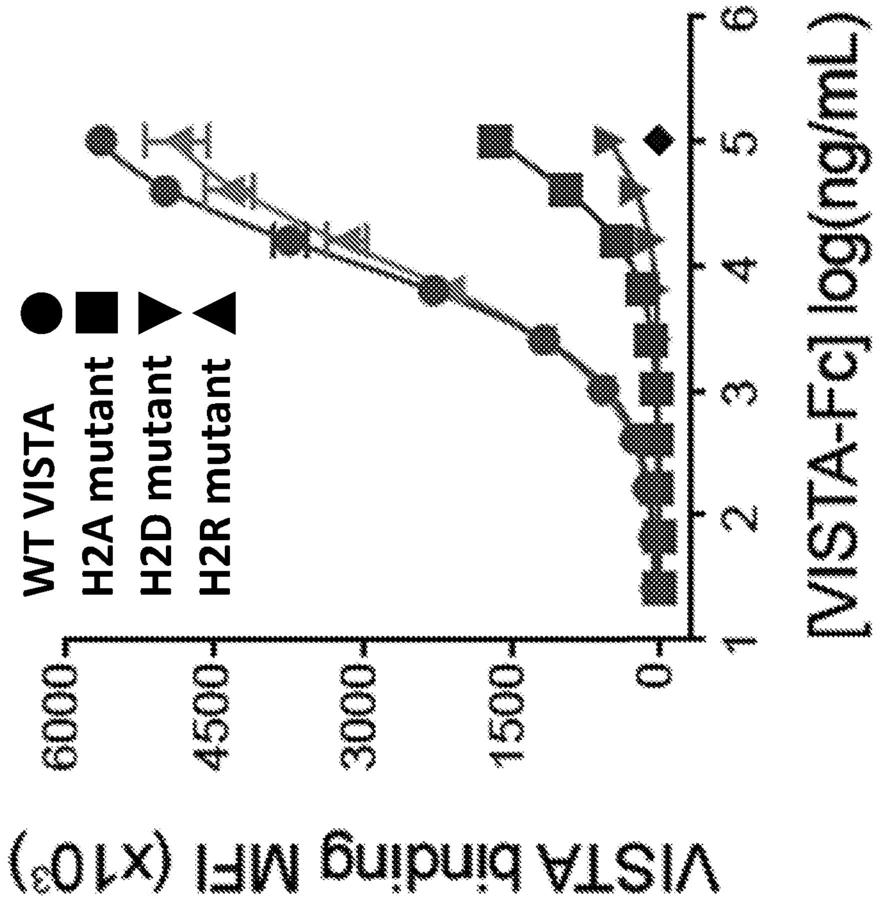

We hypothesized that VISTA binding specificity is mediated by the same histidine residues found within the VISTA blocking antibody epitope: H153, H154, and H155. Replacement of these histidine residues with noncharged alanine or negatively charged aspartic acid significantly reduced VISTA binding to recombinant PSGL-1 and CHO-PSGL-1 cells (FIGS. 25C-D). VISTA-Fc proteins with H153, H154, and H155 residues mutated to alanine, aspartic acid, or arginine were produced by transient transfection of Expi293 cells. These mutants were also unable to functionally suppress T cells (not shown in figures). In contrast, replacement with positively charged arginine residues preserved VISTA binding and function (FIG. 25C-D). The blocking antibodies VISTA.4 and P1-068767 bound well to alanine and arginine mutant VISTA, but poorly to aspartic acid mutant VISTA (not shown). The non-blocking antibody VISTA.5 bound comparably to wildtype and mutant VISTA proteins (not shown).

Figure 25E:
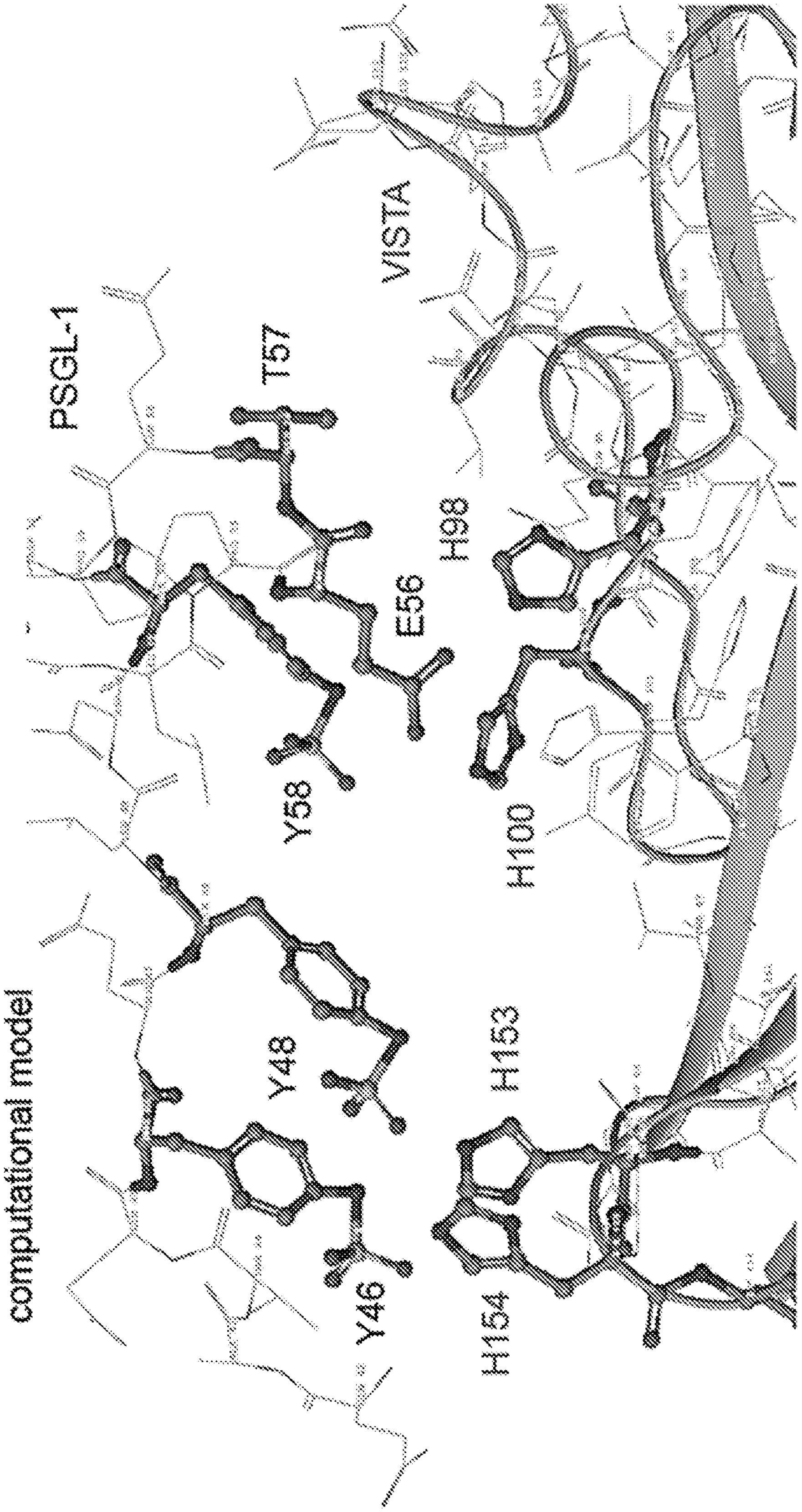

We then used the solved structures of PSGL-1 bound to P-selectin and VISTA bound to P1-068767 Fab (FIG. 18) to develop a computational model of the PSGL-1 19-mer glycopeptide docked to VISTA (FIG. 25E). In this model, PSGL-1 tyrosine residues Y46 and Y48 make ionic interactions with VISTA histidine residues H153 and H154 (2.5-3.0 Å distances). PSGL-1 Y51 is more distant from VISTA (~4.5 Å), but may interact meaningfully with VISTA H100. PSGL-1 E56 also forms ionic interactions with VISTA H98 and H100. The hydroxyl group of PSGL-1 T57, which can be decorated with sialyl lewis X, points away from VISTA, consistent with the negligible influence of sialyl lewis X on VISTA: PSGL-1 binding. Taken together, these data and modeling suggest that VISTA binding to PSGL-1 at acidic pH is driven primarily by the VISTA histidine residues and H153, H154, and H155, and by the PSGL-1 sulfated tyrosine residues Y46 and Y48.

Hydrogen/deuterium exchange mass spectrometry (HDX-MS) was utilized to probe binding epitopes of human VISTA with mAb VISTA.4. HDX-MS probes protein conformation and conformational dynamics in solution by monitoring the rate and extent of deuterium exchange of backbone amide hydrogen atoms (Huang and Chen (2014) Analytical and Bioanalytical Chemistry 406, 6541-6558; Wei, et al. Drug Discovery Today (2014) 19, 95-102). The level of HDX depends on the solvent accessibility of backbone amide hydrogen atoms and the protein hydrogen bonds. The mass increase of the protein upon HDX can be precisely measured by MS. When this technique is paired with enzymatic digestion, structure features at the peptide level can be resolved, enabling differentiation of surface exposed peptides from those folded inside, or from those sequestered at the interface of a protein-protein complex. Typically, the deuterium labeling and subsequent quenching experiments are performed, followed by enzymatic digestion, peptide separation, and MS analysis.

Prior to epitope mapping experiments, non-deuteriated experiments were carried out to generate a list of common peptides for recombinant human VISTA (15 μM) and protein complexes of VISTA with mAb VISTA.4 (1:1 molar ratio). In the HDX-MS experiment, 5 μL of each sample (VISTA or VISTA with mAb VISTA.4) was diluted into 55 μL of D20 buffer (10 mM phosphate buffer, $D_2O$, pH7.0) to start the labeling reactions. The reactions were carried out for different periods of time: 1 min, 10 min and 240 min. By the end of each labeling reaction period, the reaction was quenched by adding quenching buffer (100 mM phosphate buffer with 4M GdnCl and 0.4M TCEP, pH 2.5, 1:1, v/v) and 50 μL of quenched sample was injected into Waters HDX-MS system for analysis. The deuterium uptake levels of common peptic peptides were monitored in the absence/presence of VISTA.4. The obtained sequence coverage was 82%.

Figures 19, 20:
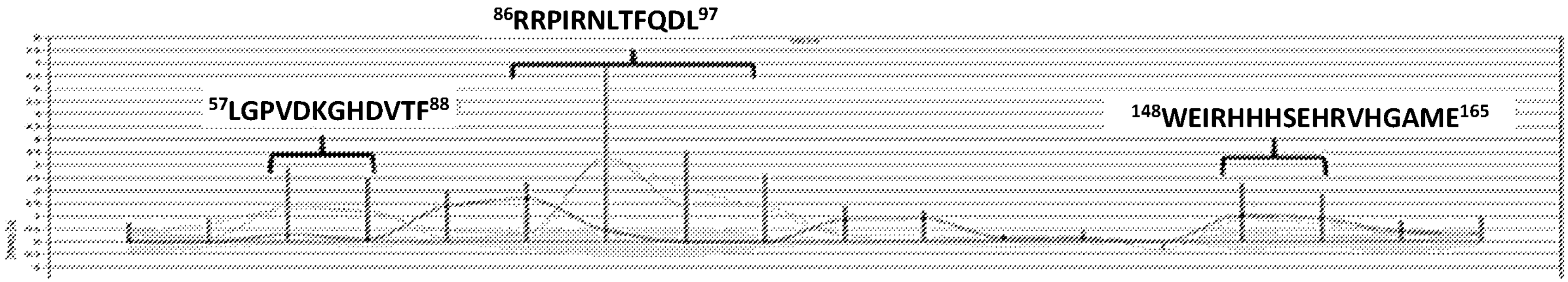
FIG. 19 shows the epitope of VISTA.4 as determined by MS-HDX (MS trace).
FIG. 20 (SEQ ID NO: 738) shows the location of the epitope of VISTA.4 in the amino acid sequence of hVISTA based on the data in FIG. 19. Residues 57-68, 86-97, and 148-165, also highlighted in FIG. 19, are depicted in lighter grey text and underlining in FIG. 20.

HDX-MS experiments provided 85% sequence coverage for human VISTA. As shown in FIG. 19, the HDX-MS data analysis on VISTA.4 in human VISTA indicates that VISTA.4's epitope is comprised of three regions of human VISTA, with region 2 being the primary epitope (residue numbers correspond to native human VISTA sequence, FIG. 20):

Region 1: (SEQ ID NO: 566)
$^{57}$LGPVDKGHDVTF$^{68}$

Region 2: (SEQ ID NO: 567)
$^{86}$RRPIRNLTFQDL$^{97}$

Region 3: (SEQ ID NO: 568)
$^{148}$VVEIRHHHSEHRVHGAME$^{165}$

Antibody VISTA.4 bound equally well at acidic and neutral pH. Further rounds of selection yielded a variant that bound VISTA with 200-fold higher affinity at pH 6.0 than at pH 7.4. Similar efforts with VISTA blocking antibodies produced variants with up to 10,000-fold selectivity for pH 6.0 relative to pH 7.4. We used these antibodies to map VISTA's receptor-ligand binding interface at acidic and neutral pH. pH-independent, neutral pH-selective, and acidic pH-selective VISTA blocking antibodies bound nearly identical epitopes, suggesting that histidine protonation alone, without marked conformational changes, controls VISTA's ability to engage its counter-receptor at acidic pH. (VISTA.4 is further described in another application family by the same applicants.)

Example 26: VISTA: PSGL-1 Binding Specificity is Determined by Histidine and Sulfotyrosine Residues To characterize PSGL-1 binding specificity, in addition to that provided by sialyl lewis X, we examined tyrosine sulfation post-translational modifications that contribute to P-selectin binding. To test the role of tyrosine sulfation, PSGL-1 glycopeptides were fractioned into sulfotyrosine-rich (>90%) and sulfotyrosine-poor (<1%) peaks by anion exchange liquid chromatography. Neither VISTA nor P-selectin bound detectably to sulfotyrosine-poor PSGL-1 (FIG. 25B). VISTA was also unable to bind PSGL-1 glycopeptides in which tyrosines were substituted with alanines (not shown in figures). These results indicate that sulfotyrosine residues are key mediators of PSGL-1 binding to VISTA.

We hypothesized that VISTA binding specificity is mediated by the same histidine residues found within the VISTA blocking antibody epitope: H153, H154, and H155 (see Example 20). Replacement of these histidine residues with noncharged alanine or negatively charged aspartic acid significantly reduced VISTA binding to recombinant PSGL-1 and CHO-PSGL-1 cells (FIGS. 25C-D). VISTA-Fc proteins with H153, H154, and H155 residues mutated to alanine, aspartic acid, or arginine were produced by transient transfection of Expi293 cells. These mutants were also unable to functionally suppress T cells (not shown in figures). In contrast, replacement with positively charged arginine residues preserved VISTA binding and function (FIG. 25C-D). The blocking antibodies VISTA.4 and P1-068767 bound well to alanine and arginine mutant VISTA, but poorly to aspartic acid mutant VISTA (not shown). The non-blocking antibody VISTA.5 bound comparably to wild-type and mutant VISTA proteins (not shown).

We then used the solved structures of PSGL-1 bound to P-selectin and VISTA bound to P1-068767 Fab (FIG. 18) to develop a computational model of the PSGL-1 19-mer glycopeptide docked to VISTA (FIG. 25E). In this model, PSGL-1 tyrosine residues Y46 and Y48 make ionic interactions with VISTA histidine residues H153 and H154 (2.5-3.0 Å distances). PSGL-1 Y51 is more distant from VISTA (~4.5 Å), but may interact meaningfully with VISTA H100. PSGL-1 E56 also forms ionic interactions with VISTA H98 and H100. The hydroxyl group of PSGL-1 T57, which can be decorated with sialyl lewis X, points away from VISTA, consistent with the negligible influence of sialyl lewis X on VISTA: PSGL-1 binding. Taken together, these data and modeling suggest that VISTA binding to PSGL-1 at acidic pH is driven primarily by the VISTA histidine residues and H153, H154, and H155, and by the PSGL-1 sulfated tyrosine residues Y46 and Y48.

Example 27: Impact of Antibodies on VISTA-VSIG-3 Binding

VISTA has recently been reported to bind V-set Immunoglobulin domain containing 3 (VSIG-3), a surface receptor expressed in brain, testis, and some cancer tissues.

BLI binding experiments were performed to evaluate multi-pH interactions of VISTA to VSIG-3, CD42b/GP1Ba, PSGL-1, and VISTA. All assay steps were performed in DPBS buffer (Gibco) containing 0.05% V/V Tween 20, pH-adjusted to 5.8, 6.2, 6.6, 7.0, or 7.4 as indicated. The experimental conditions described above were applied, with the exception that 200 nM human VISTA-Fc was first captured to AHC sensors, and binding was instead measured to 500 nM wildtype human PSGL-1 19-mer Fc fusion protein, 500 nM and Y2A mutant human PSGL-1 19-mer Fc fusion protein, 500 nM human VSIG-3-Fc fusion protein (R&D Systems), 500 nM human CD42b/GP1Ba (R&D Systems), or 500 nM human VISTA-Fc fusion protein (R&D Systems).

Figure 26A:
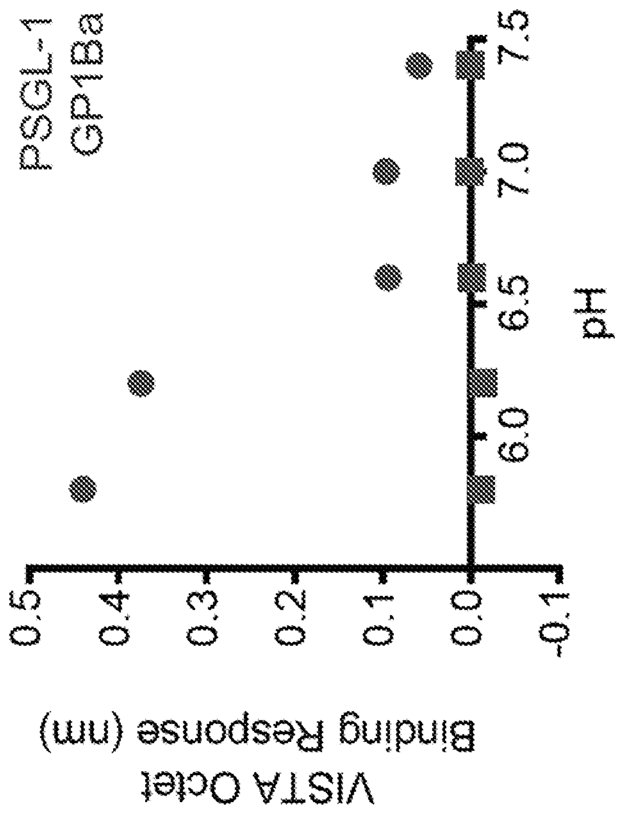
FIGS. 26A-F.
Figure 26B:
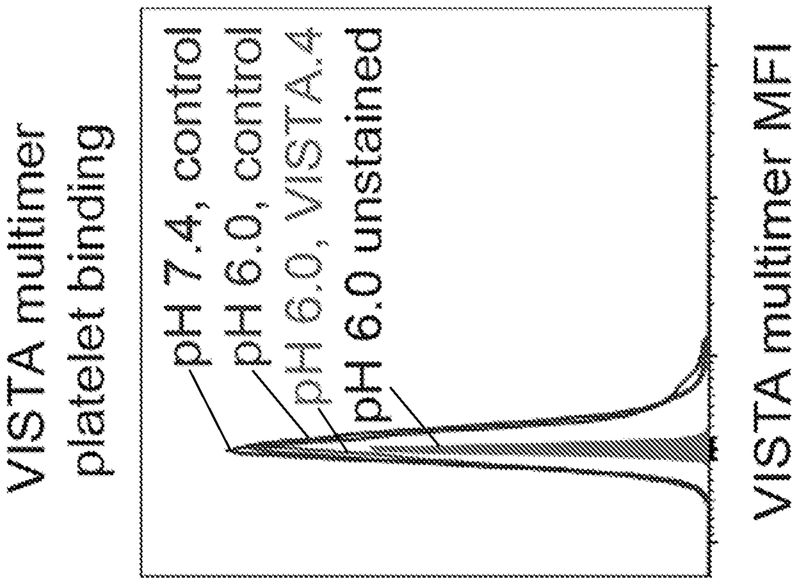
Figure 26C:
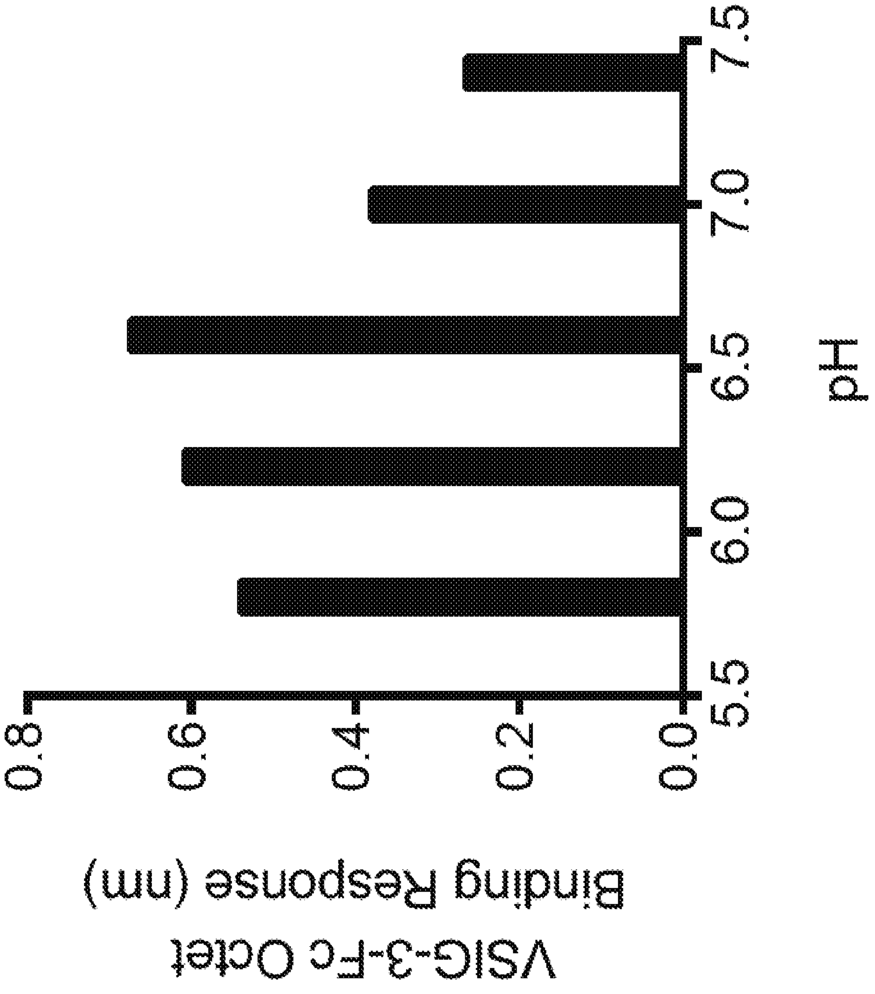
Figure 26D:
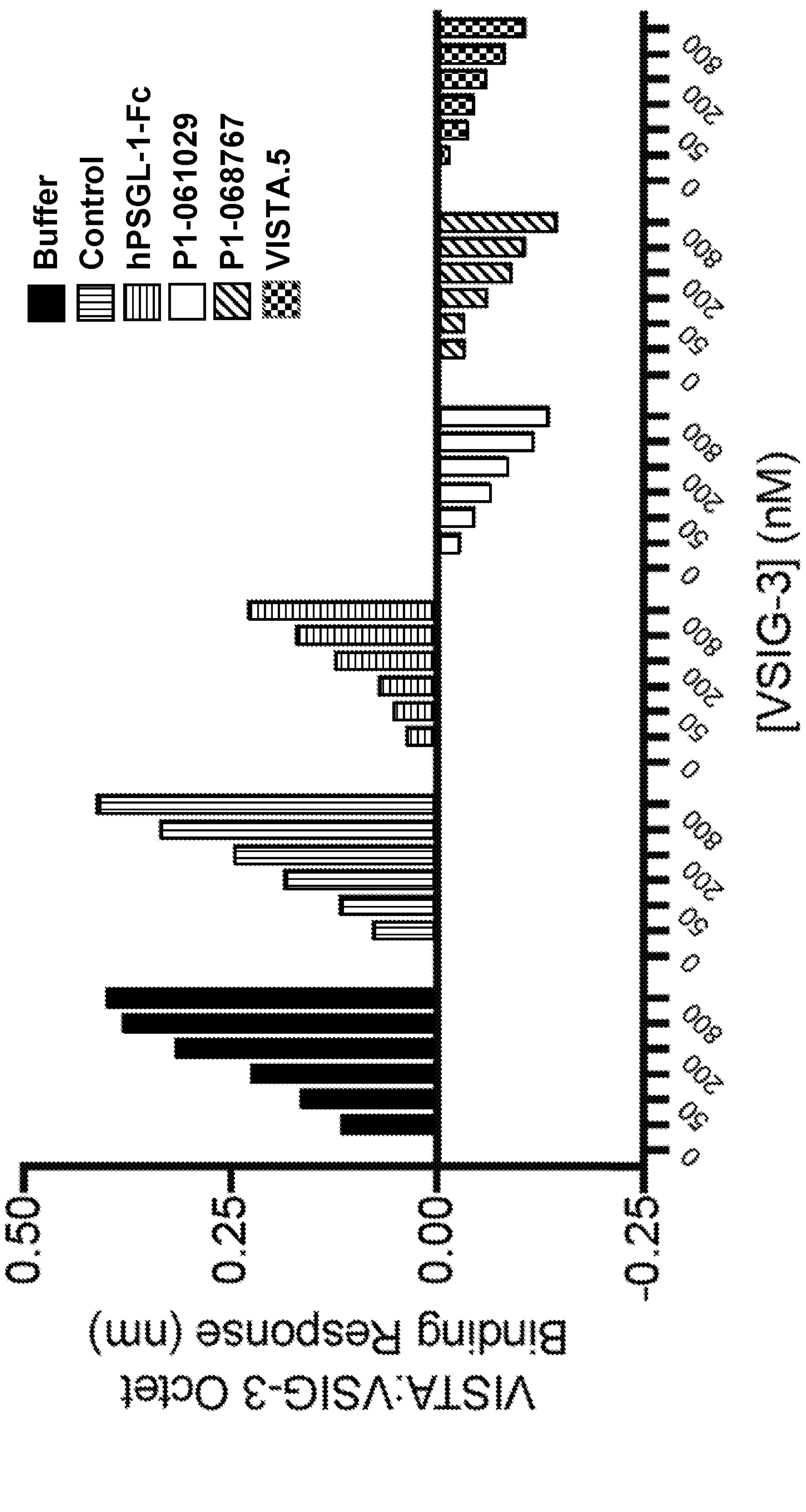
Figure 26E:
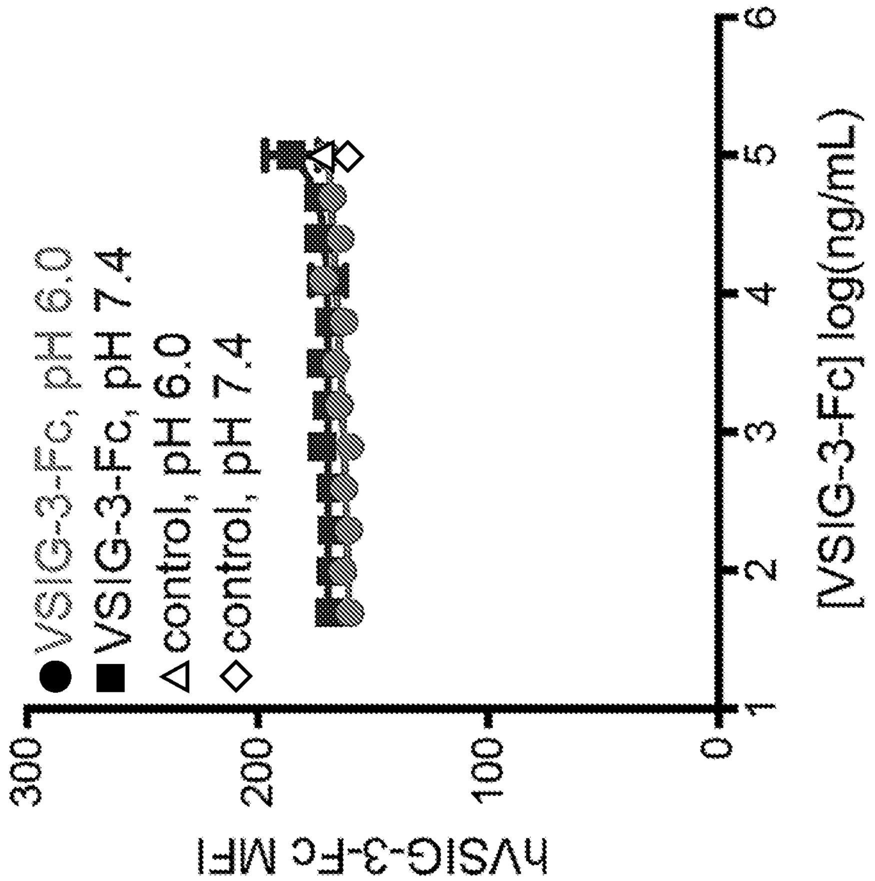
Figure 26F:
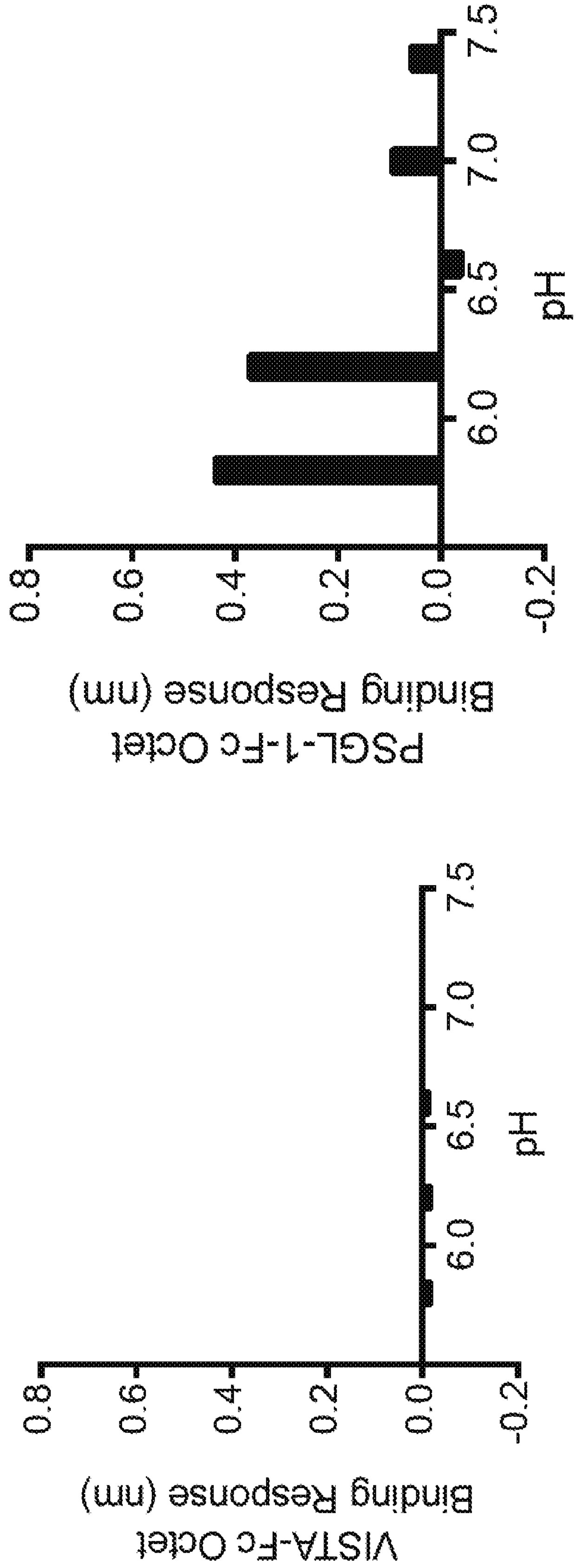

The effect of anti-VISTA antibodies on the interaction between hVISTA and hVSIG-3 was determined in competition experiments. For antibody and VSIG-3 competition experiments, human VISTA-Fc was diluted to 400 nM and premixed for 30 minutes with 0 nM, 200 nM, 400 nM, or 800 nM of each test antibody or human VSIG-3-Fc fusion protein (R&D Systems) prior to assessing binding. For KPL-1 and human P-selectin competition experiments, captured human PSGL-1 19-mer Fc fusion protein was blocked using 400 nM KPL-1 (Millipore Sigma) or 400 nM human P-selectin (R&D Systems), then dipped into titrated human VISTA-Fc. The results, which are shown in FIG. 26, indicate that binding of recombinant VISTA to recombinant VSIG-3 is moderately pH selective (FIG. 26C) and that P1-061029 and P1-068767 and to a smaller degree VISTA.5 inhibit binding of h VISTA to hVSIG-3 (FIG. 26D). There was no evidence of competition between VSIG-3 and PSGL-1.

Example 28: Accumulation of VISTA Antibodies in Tumor Tissues

Figure 27A:
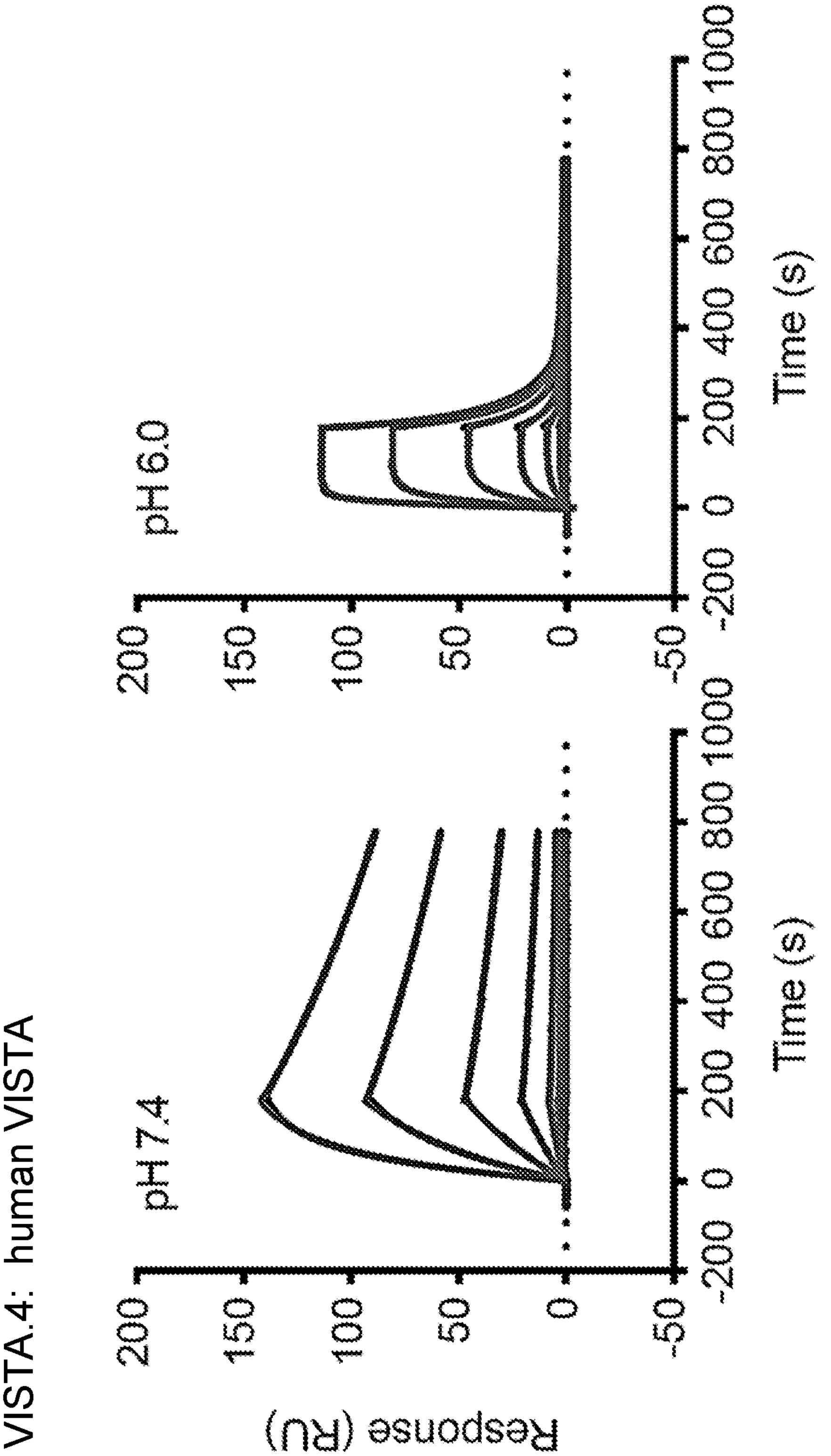
FIGS. 27A-F.
Figure 27B:
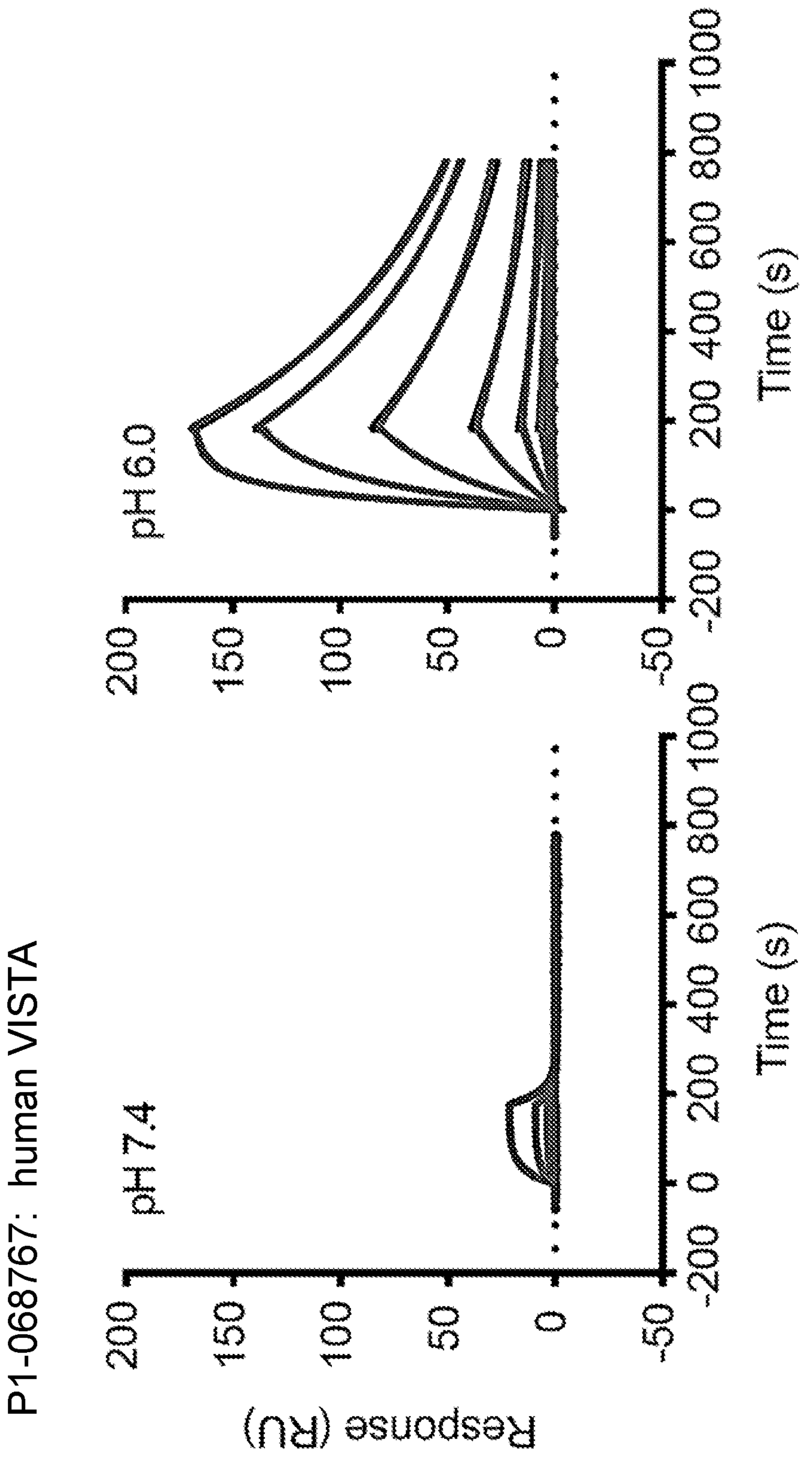
Figure 27C:
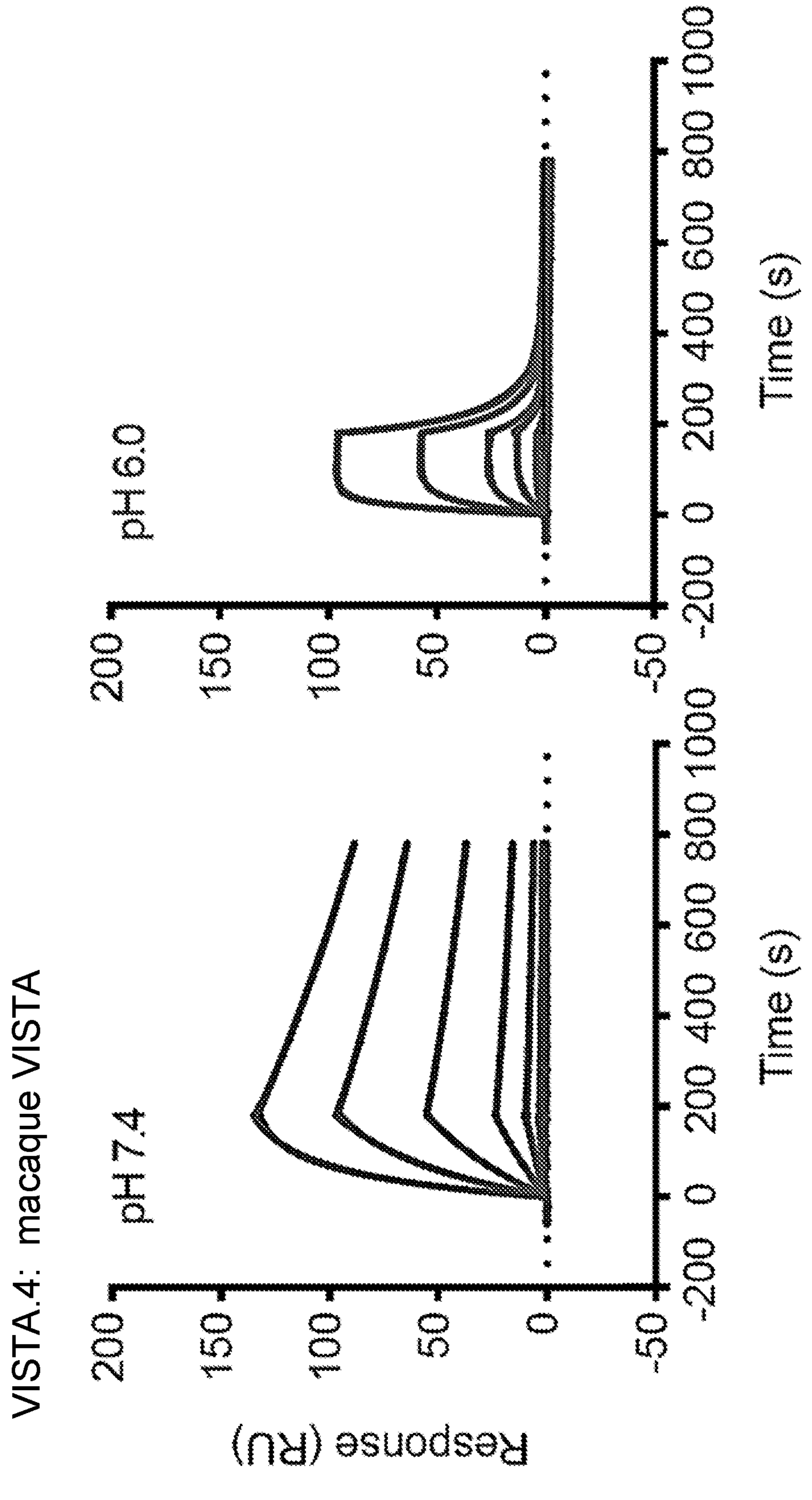
Figure 27D:
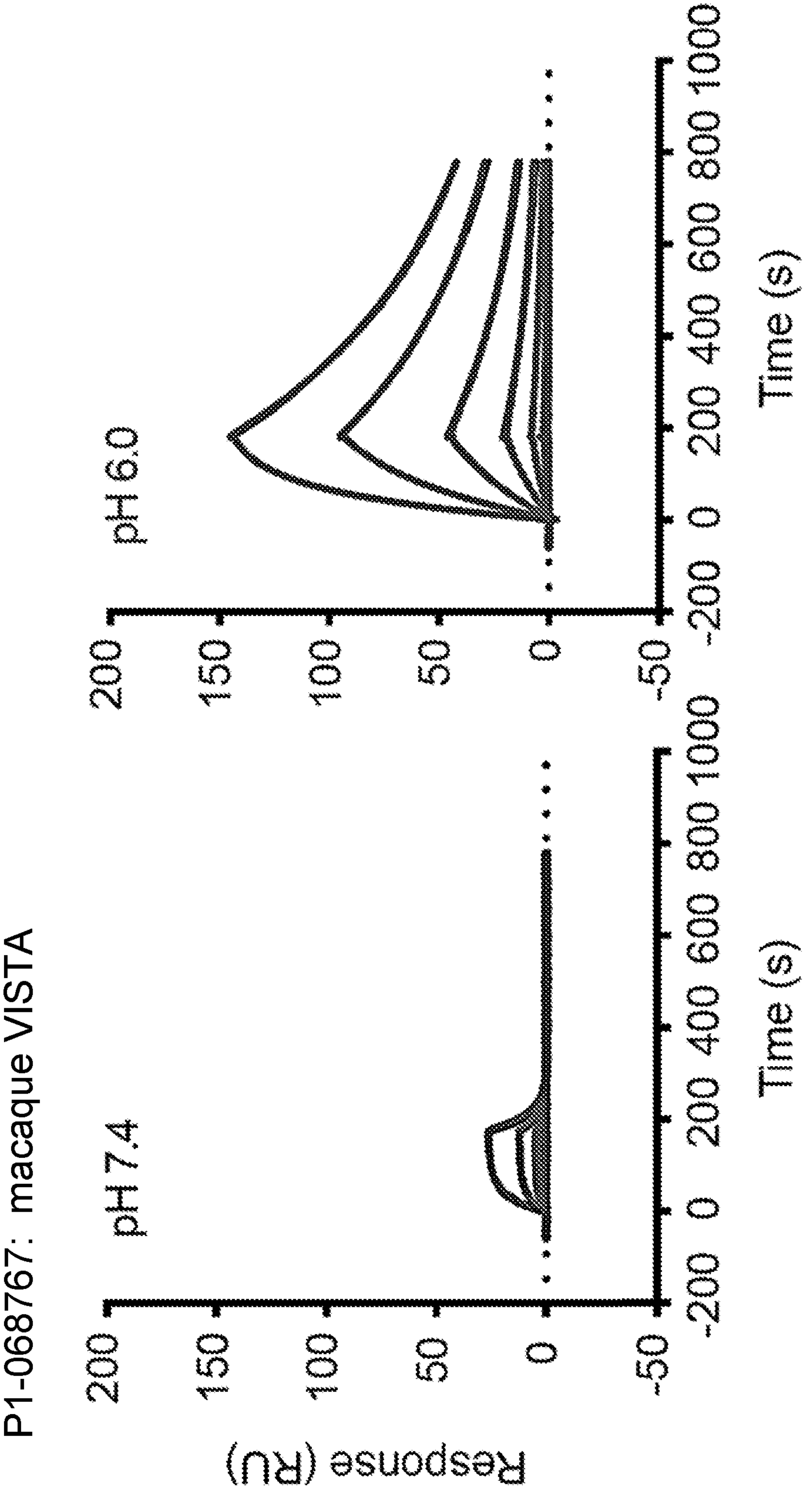
Figure 27E:
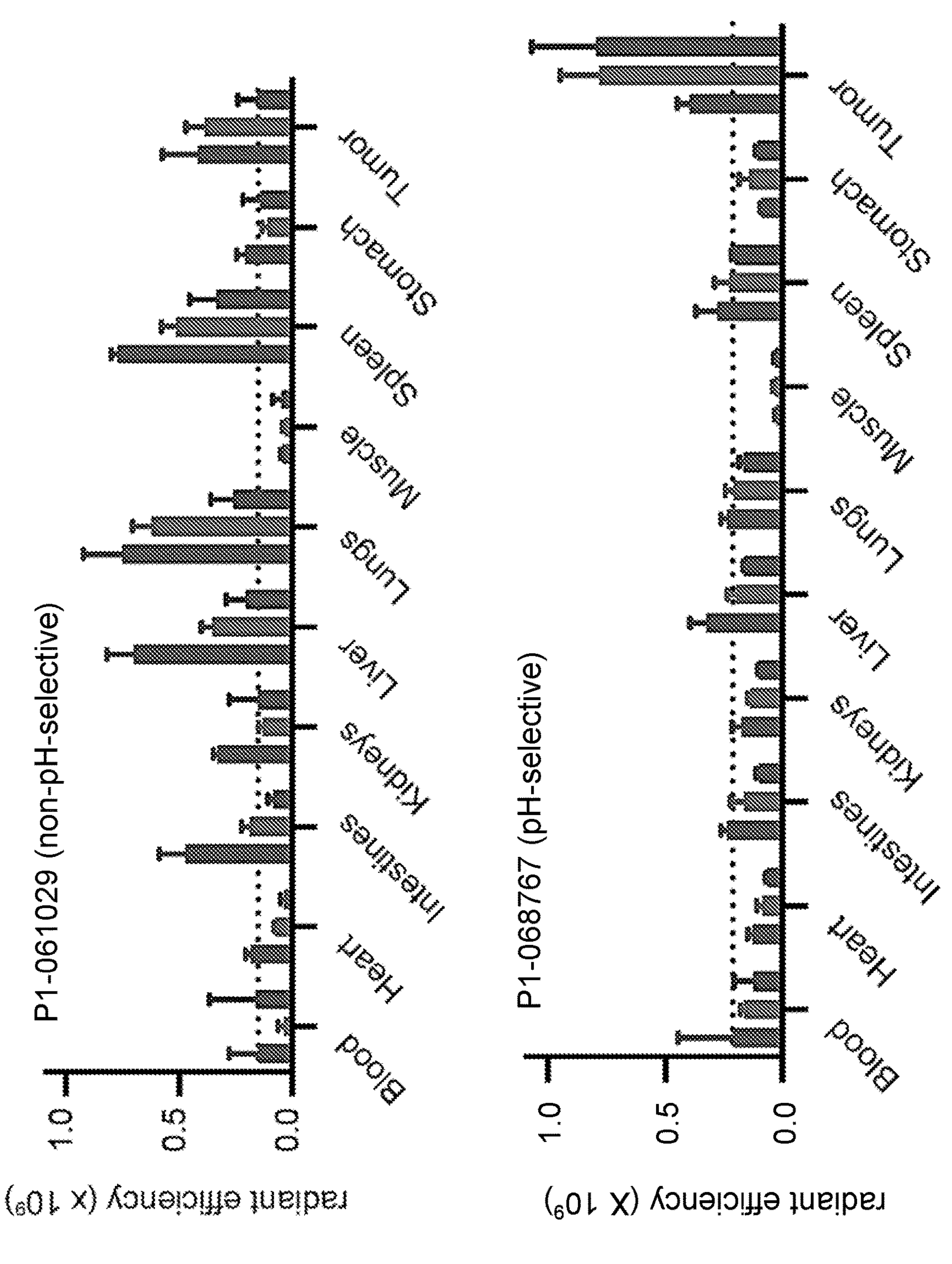
Figure 27F:
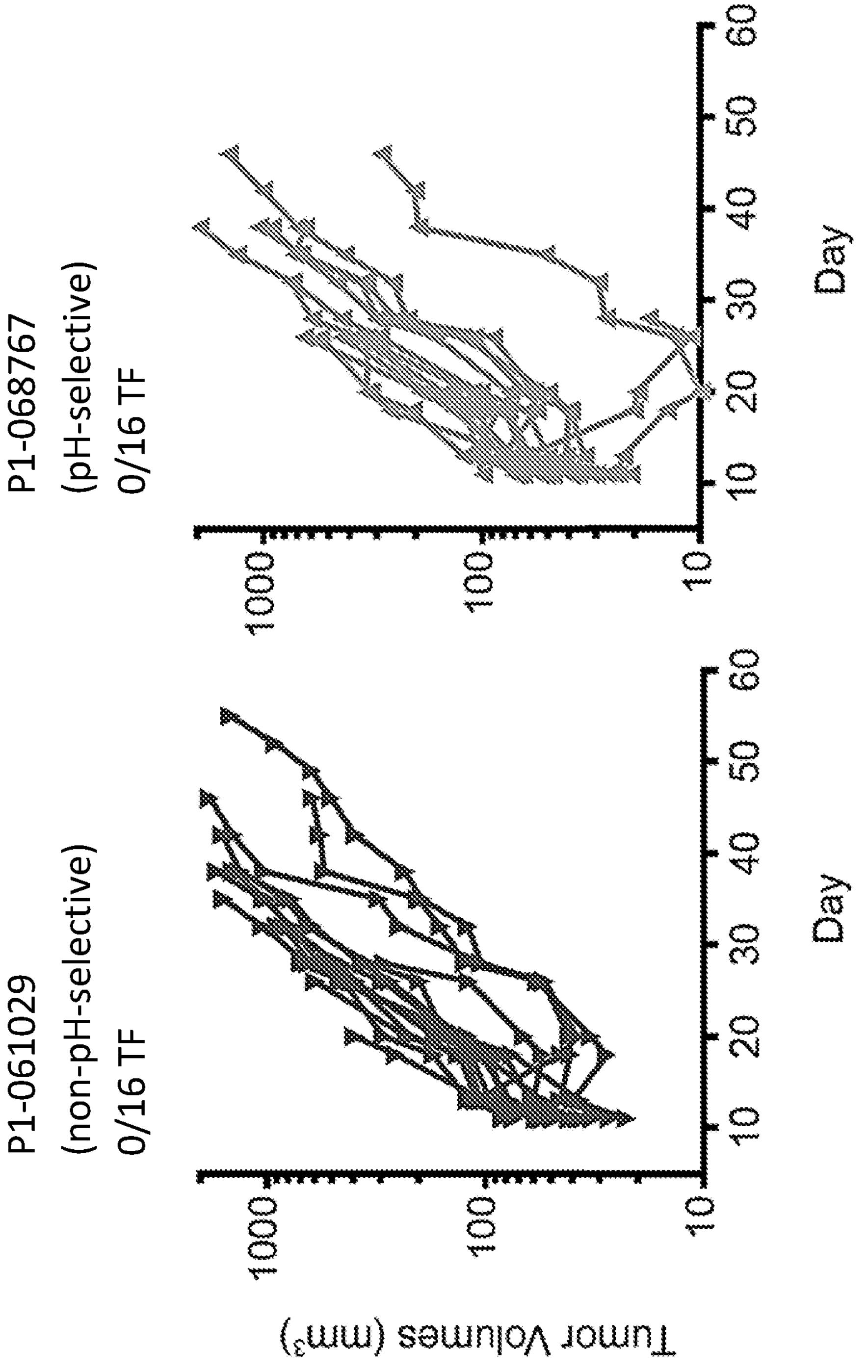
Figure 28:
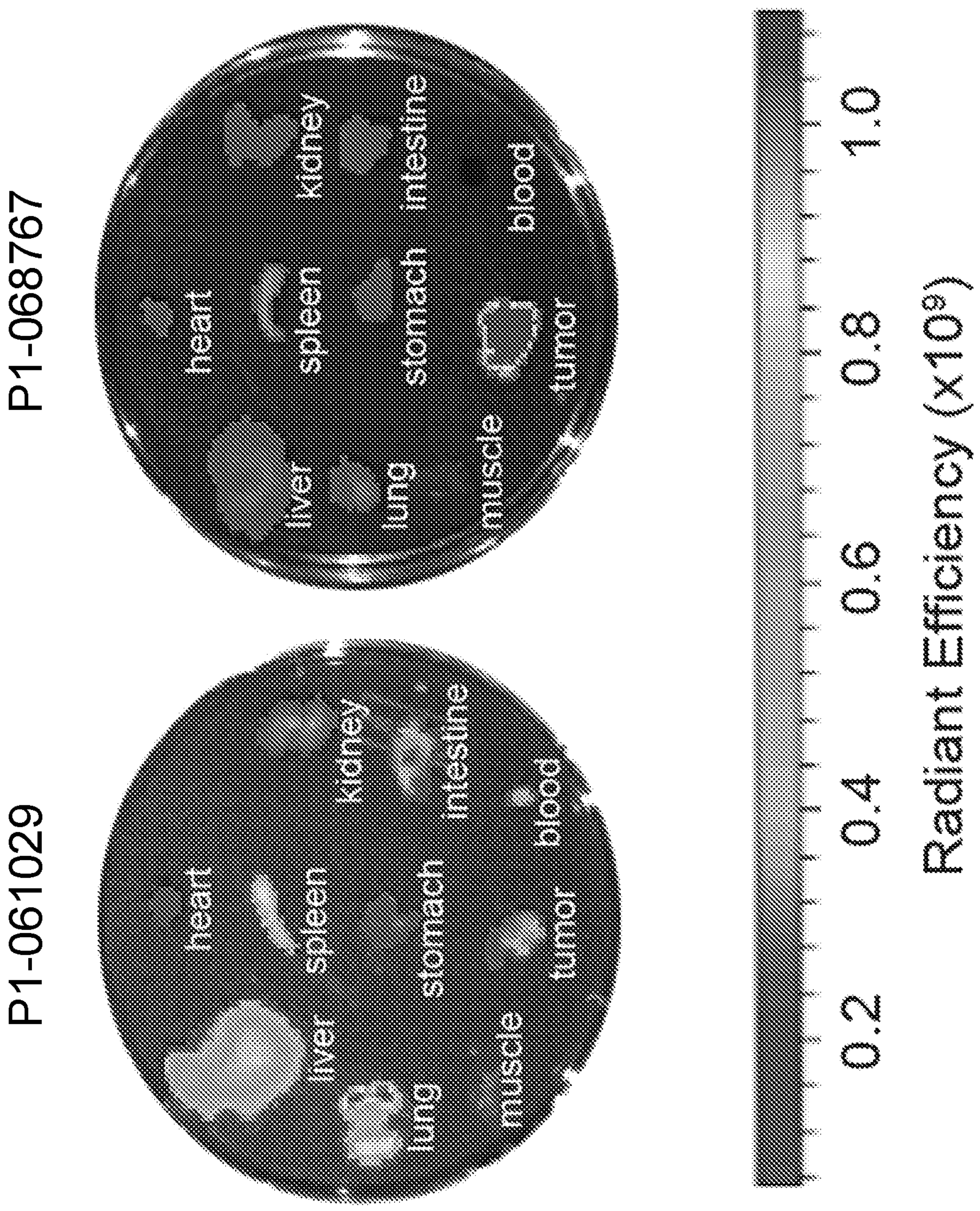
FIG. 28 shows results of an experiment in which human VISTA knock-in mice were implanted with MC38 tumors and treated with fluorescently labeled P1-061029 (left) or P1-068767 (right). Radiant efficiencies ($\times 10^9$) in the indicated organs at 51 hours post-injection are shown. These data are representative of a single experiment.

As shown in FIG. 28, human VISTA knock-in mice were implanted with MC38 tumors and treated with fluorescently labeled P1-061029 (left) or P1-068767 (right). Radiant efficiencies ($\times 10^9$) in the indicated organs at 51 hours post-injection are shown. These data are representative of a single experiment. As shown in the figure, pH-sensitive antibody P1-068767 accumulated preferentially in tumors, while P1-061029 localized primarily to leukocyte-rich organs (e.g., lungs, liver, spleen). (See also FIG. 27E.) Despite inefficient engagement of peripheral VISTA, P1-068767 matched P1-061029 in therapeutic benefit when administered in combination with anti-PD-1 (see FIGS. 15J-M). This result suggests that VISTA's immunosuppressive activity occurs primarily within acidic microenvironments, and that pH selectivity may be useful in the development of therapeutic agents against VISTA and other targets that are active in tumors. Further data on the tissue accumulation of anti-VISTA antibodies are shown in FIG. 27E.

Activation-induced expression of co-inhibitory receptors typically results in preferential restraint of matured immune responses rather than nascent ones. VISTA instead appears to rely on pH selectivity to achieve this outcome, with suppression occurring in inflamed tissues such as tumor beds but not in the blood or lymphoid organs. While the existence and immunosuppressive effects of tumor acidosis are well known, these findings demonstrate that pH can also directly modulate immune checkpoint engagement.

Example 29: Further Binding Kinetics Data on VISTA Antibodies

Further binding kinetic experiments were performed at various pHs on VISTA antibodies described herein by SPR as generally described in Example 9 above. Antibodies were normalized to 50 nM concentration in PBST pH 7.4 and captured on a Protein A CM5 chip (ID 4931) by injecting for 45 seconds at a 5 L/min flow rate. An 8-point human VISTA titration (100 to 7.8 nM) was prepared in PBST at pH 7.4, 6.9, 6.45, and 6.0. Titrations were injected over the captured antibodies for 180 seconds at 30 μL/min. Sensorgrams were fit to a 1:1 binding model in T200 evaluation software and the kinetic constants were reported.

Resulting data are provided in Tables 23-26 below. Each table reports the data at one of the four tested pHs (7.4, 6.9, 6.45, and 6.0, respectively). The 8-point hVISTA titration used in these assays was chosen to provide increased confidence in kinetic values reported at neutral pH conditions. A relatively stringent cutoff for non-binding was applied in this assay. Certain progeny of P1-061029 antibody (P1-068757, '759, '765, '771, and '775) show no binding to hVISTA at micromolar concentrations at pH 7.4, while '761 and '767 show no binding to h VISTA at 100 nM at pH 7.4 but do show binding to hVISTA at micromolar concentrations.

TABLE 23

Binding kinetics at pH 7.4.

| Ligand | Description | ka (1/Ms) | kd (1/s) | KD (M) | 7.4 kd/ 6.0 kd | 7.4 KD/ 6.0 KD |
|---|---|---|---|---|---|---|
| P1-061029-18 | VPGYSGGWIDAFDV (SEQ ID NO: 67 Residues 99-112) | 4.63E+05 | 6.03E-03 | 1.30E-08 | 1.1 | 4.5 |
| P1-068765-10 | 029 progeny | Low or no binding | | | N/A | N/A |
| P1-068775-8 | 029 progeny | Low or no binding | | | N/A | N/A |
| P1-068757-9 | 029 progeny | Low or no binding | | | N/A | N/A |
| P1-068771-10 | 029 progeny | Low or no binding | | | N/A | N/A |
| P1-068759-9 | 029 progeny | Low or no binding | | | N/A | N/A |
| P1-072000-3 | P1-061029_F100fE_V102D | 1.4E+04 | 3.8E-02 | 2.7E-06 | 14.2 | 257.5 |
| P1-072000-3 | P1-061029_F100fE_V102D | 2.4E+04 | 3.2E-02 | 1.4E-06 | 12.4 | 237.3 |
| P1-068761-20 | P1-061029 HC: D30E_Y32E_A55E_N56E_G100H_F100fE | Low or no binding | | | N/A | N/A |
| P1-070864-3 | P1-068761_E30D | Low or no binding | | | N/A | N/A |
| P1-070890-3 | P1-068761_E30D_E55A | Low or no binding | | | N/A | N/A |
| P1-070868-6 | P1-068761_E55A | 1.3E+04 | 4.4E-02 | 3.4E-06 | 18.9 | 625.2 |
| P1-070878-3 | P1-068761_E55A_E56N | Low or no binding | | | N/A | N/A |
| P1-070870-3 | P1-068761_E56N | Low or no binding | | | N/A | N/A |
| P1-070900-3 | P1-068761_E56N_H100G | Low or no binding | | | N/A | N/A |
| P1-070872-4 | P1-068761_H100G | Low or no binding | | | N/A | N/A |
| P1-068767-22 | P1-061029 HC: D30E_N51D_A55E_F100fE_V102D | Low or no binding | | | N/A | N/A |
| P1-070906-6 | P1-068767_D52N | 6.5E+03 | 2.9E-02 | 4.4E-06 | 15.3 | 731.3 |
| P1-070916-6 | P1-068767_D52N_E55A | 1.0E+04 | 3.8E-02 | 3.7E-06 | 19.4 | 562.9 |
| P1-070904-3 | P1-068767_E30D | Low or no binding | | | N/A | N/A |
| P1-070914-3 | P1-068767_E30D_D52N | 8.4E+03 | 3.5E-02 | 4.2E-06 | 14.6 | 396.3 |
| P1-070922-3 | P1-068767_E30D_E55A | Low or no binding | | | N/A | N/A |
| P1-070908-6 | P1-068767_E55A | 6.7E+04 | 2.4E-02 | 3.5E-07 | 8.6 | 34.5 |
| P1-061015 | DSGFYSSYYFDY (SEQ ID NO: 95 Residues 99-110) | 3.29E+05 | 1.68E-03 | 5.12E-09 | 1.1 | 8.2 |
| P1-068744-7 | P1-061015 HC: S31E_150H_Y59E_S100E_Y102E | Low or no binding | | | N/A | N/A |
| P1-068748-6 | P1-061015 HC: S31HY32H_K57D_Y58D_S100D | 4.0E+04 | 3.6E-02 | 9.2E-07 | 9.9 | 211.8 |
| P1-061520-21 | 41F11 VK_A64G | 6.13E+05 | 8.71E-04 | 1.42E-09 | 0.0 | 0.1 |
| P1-070976-11 | 41F11_VH_T28P_Y50W_S55E_D95H_L96E_P97E_Y100E; Vk_A64G | 2.4E+03 | 1.6E-02 | 6.9E-06 | 7.0 | 695.7 |

TABLE 24

| Binding kinetics at pH 6.9 | | | | | | |
|---|---|---|---|---|---|---|
| Ligand | Description | ka (1/Ms) | kd (1/s) | KD (M) | 7.4 kd/ 6.0 kd | 7.4 KD/ 6.0 KD |
| P1-061029-18 | VPGYSGGWIDAFDV (SEQ ID NO: 67 Residues 99-112) | 5.83E+05 | 4.16E-03 | 7.13E-09 | 0.8 | 2.5 |
| P1-068765-10 | 029 progeny | Low or no binding | | | N/A | N/A |
| P1-068775-8 | 029 progeny | Low or no binding | | | N/A | N/A |
| P1-068757-9 | 029 progeny | Low or no binding | | | N/A | N/A |
| P1-068771-10 | 029 progeny | Low or no binding | | | N/A | N/A |
| P1-068759-9 | 029 progeny | Low or no binding | | | N/A | N/A |
| P1-072000-3 | P1-061029_F100fE_V102D | 3.9E+04 | 1.1E-02 | 2.8E-07 | 4.1 | 26.0 |
| P1-072000-3 | P1-061029_F100fE_V102D | 4.2E+04 | 1.1E-02 | 2.5E-07 | 4.0 | 43.0 |
| P1-068761-20 | P1-061029 HC: D30E_Y32E_A55E_N56E_G100H_F100fE | 5.87E+04 | 8.32E-03 | 1.42E-07 | 4.1 | 52.4 |
| P1-070864-3 | P1-068761_E30D | 4.2E+03 | 3.4E-02 | 8.1E-06 | 4.9 | 522.7 |
| P1-070890-3 | P1-068761_E30D_E55A | 9.0E+03 | 4.0E-02 | 4.4E-06 | 4.9 | 211.0 |
| P1-070868-6 | P1-068761_E55A | 2.3E+03 | 1.5E-02 | 6.7E-06 | 6.5 | 1237.5 |
| P1-070878-3 | P1-068761_E55A_E56N | 2.9E+03 | 2.8E-02 | 9.8E-06 | 4.5 | 300.9 |
| P1-070870-3 | P1-068761_E56N | 4.9E+03 | 4.9E-02 | 1.0E-05 | 7.9 | 315.6 |
| P1-070900-3 | P1-068761_E56N_H100G | 8.5E+03 | 3.1E-02 | 3.7E-06 | 3.7 | 221.7 |
| P1-070872-4 | P1-068761_H100G | 1.9E+03 | 2.8E-02 | 1.5E-05 | 5.1 | 1820.4 |
| P1-068767-22 | P1-061029 HC: D30E_N51D_A55E_F100fE_V102D | 2.67E+04 | 1.03E-02 | 3.85E-07 | 3.5 | 56.8 |
| P1-070906-6 | P1-068767_D52N | 3.8E+04 | 8.4E-03 | 2.2E-07 | 4.4 | 36.5 |
| P1-070916-6 | P1-068767_D52N_E55A | 4.1E+04 | 9.3E-03 | 2.3E-07 | 4.8 | 35.1 |
| P1-070904-3 | P1-068767_E30D | 1.1E+05 | 2.8E-02 | 2.5E-07 | 7.2 | 14.9 |
| P1-070914-3 | P1-068767_E30D_D52N | 4.8E+04 | 1.1E-02 | 2.3E-07 | 4.4 | 21.1 |
| P1-070922-3 | P1-068767_E30D_E55A | 1.8E+04 | 1.4E-02 | 7.9E-07 | 3.4 | 45.9 |
| P1-070908-6 | P1-068767_E55A | 5.1E+04 | 1.2E-02 | 2.4E-07 | 4.4 | 23.0 |
| P1-061015 | DSGFYSSYYFDY (SEQ ID NO: 95 Residues 99-110) | 4.17E+05 | 1.33E-03 | 3.19E-09 | 0.9 | 5.1 |
| P1-068744-7 | P1-061015 HC: S31E_150H_Y59E_S100E_Y102E | 7.1E+03 | 3.4E-02 | 4.8E-06 | 7.9 | 958.4 |
| P1-068748-6 | P1-061015 HC: S31HY32H_K57D_Y58D_S100D | 8.2E+04 | 1.8E-02 | 2.2E-07 | 4.8 | 50.0 |
| P1-061520-21 | 41F11 VK_A64G | 6.46E+05 | 1.39E-03 | 2.15E-09 | 0.0 | 0.1 |
| P1-070976-11 | 41F11_VH_T28P_Y50W_S55E_D95H_L96E_P97E_Y100E; Vk_A64G | 1.1E+04 | 1.0E-02 | 9.7E-07 | 4.4 | 98.2 |

TABLE 25

| Binding kinetics at pH 6.45 | | | | | | |
|---|---|---|---|---|---|---|
| Ligand | Description | ka (1/Ms) | kd (1/s) | KD (M) | 7.4 kd/ 6.0 kd | 7.4 KD/ 6.0 KD |
| P1-061029-18 | VPGYSGGWIDAFDV (SEQ ID NO: 67 Residues 99-112) | 8.76E+05 | 4.50E-03 | 5.13E-09 | 0.9 | 1.8 |
| P1-068765-10 | 029 progeny | 3.1E+04 | 1.3E-02 | 4.2E-07 | 2.8 | 14.2 |
| P1-068775-8 | 029 progeny | 7.7E+04 | 1.7E-02 | 2.2E-07 | 1.8 | 2.8 |
| P1-068757-9 | 029 progeny | 1.3E+05 | 1.8E-02 | 1.4E-07 | 1.7 | 5.8 |
| P1-068771-10 | 029 progeny | 6.1E+04 | 2.2E-02 | 3.7E-07 | 2.2 | 11.6 |
| P1-068759-9 | 029 progeny | Low or no binding | | | N/A | N/A |
| P1-072000-3 | P1-061029_F100fE_V102D | 1.1E+05 | 5.3E-03 | 4.7E-08 | 2.0 | 4.4 |
| P1-072000-3 | P1-061029_F100fE_V102D | 1.6E+05 | 4.4E-03 | 2.7E-08 | 1.7 | 4.7 |
| P1-068761-20 | P1-061029 HC: D30E_Y32E_A55E_N56E_G100H_F100fE | 1.90E+05 | 3.09E-03 | 1.62E-08 | 1.5 | 6.0 |
| P1-070864-3 | P1-068761_E30D | 4.1E+05 | 4.6E-02 | 1.1E-07 | 6.8 | 7.4 |
| P1-070890-3 | P1-068761_E30D_E55A | 2.4E+05 | 3.2E-02 | 1.3E-07 | 3.9 | 6.3 |
| P1-070868-6 | P1-068761_E55A | 2.4E+05 | 8.7E-03 | 3.6E-08 | 3.7 | 6.7 |
| P1-070878-3 | P1-068761_E55A_E56N | 7.8E+04 | 1.2E-02 | 1.6E-07 | 2.0 | 4.9 |
| P1-070870-3 | P1-068761_E56N | 8.0E+04 | 1.2E-02 | 1.5E-07 | 1.9 | 4.6 |
| P1-070900-3 | P1-068761_E56N_H100G | 4.5E+05 | 6.0E-02 | 1.3E-07 | 7.1 | 8.0 |
| P1-070872-4 | P1-068761_H100G | 3.6E+05 | 2.5E-02 | 6.8E-08 | 4.5 | 8.3 |
| P1-068767-22 | P1-061029 HC: D30E_N51D_A55E_F100fE_V102D | 1.41E+05 | 4.47E-03 | 3.18E-08 | 1.5 | 4.7 |
| P1-070906-6 | P1-068767_D52N | 1.3E+05 | 3.9E-03 | 3.1E-08 | 2.1 | 5.1 |
| P1-070916-6 | P1-068767_D52N_E55A | 1.2E+05 | 4.0E-03 | 3.5E-08 | 2.1 | 5.4 |
| P1-070904-3 | P1-068767_E30D | 1.3E+05 | 8.6E-03 | 6.8E-08 | 2.3 | 4.1 |
| P1-070914-3 | P1-068767_E30D_D52N | 1.1E+05 | 4.9E-03 | 4.6E-08 | 2.0 | 4.3 |
| P1-070922-3 | P1-068767_E30D_E55A | 9.3E+04 | 7.0E-03 | 7.6E-08 | 1.7 | 4.4 |
| P1-070908-6 | P1-068767_E55A | 1.1E+05 | 6.0E-03 | 5.4E-08 | 2.2 | 5.2 |
| P1-061015 | DSGFYSSYYFDY (SEQ ID NO: 95 Residues 99-110) | 8.03E+05 | 1.47E-03 | 1.83E-09 | 1.0 | 2.9 |
| P1-068744-7 | P1-061015 HC: S31E_150H_Y59E_S100E_Y102E | 2.2E+05 | 1.4E-02 | 6.4E-08 | 3.2 | 12.6 |
| P1-068748-6 | P1-061015 HC: S31HY32H_K57D_Y58D_S100D | 6.8E+05 | 1.2E-02 | 1.8E-08 | 3.4 | 4.1 |
| P1-061520-21 | 41F11 VK_A64G | 9.75E+05 | 5.54E-03 | 5.69E-09 | 0.2 | 0.3 |
| P1-070976-11 | 41F11_VH_T28P_Y50W_S55E_D95H_L96E_ P97E_Y100E; Vk_A64G | 9.0E+04 | 3.9E-03 | 4.4E-08 | 1.7 | 4.4 |

TABLE 26

| Binding kinetics at pH 6.0 | | | | |
|---|---|---|---|---|
| Ligand | Description | ka (1/Ms) | kd (1/s) | KD (M) |
| P1-061029-18 | VPGYSGGWIDAFDV (SEQ ID NO: 67 Residues 99-112) | 1.81E+06 | 5.27E-03 | 2.91E-09 |
| P1-068765-10 | 029 progeny | 1.5E+05 | 4.5E-03 | 2.9E-08 |
| P1-068775-8 | 029 progeny | 1.2E+05 | 9.0E-03 | 7.7E-08 |
| P1-068757-9 | 029 progeny | 4.2E+05 | 1.0E-02 | 2.4E-08 |

TABLE 26-continued

| Binding kinetics at pH 6.0 | | | | |
|---|---|---|---|---|
| Ligand | Description | ka (1/Ms) | kd (1/s) | KD (M) |
| P1-068771-10 | 029 progeny | 3.2E+05 | 1.0E-02 | 3.2E-08 |
| P1-068759-9 | 029 progeny | 6.0E+05 | 5.8E-02 | 9.6E-08 |
| P1-072000-3 | P1-061029_F100fE_V102D | 2.5E+05 | 2.7E-03 | 1.1E-08 |
| P1-072000-3 | P1-061029_F100fE_V102D | 4.5E+05 | 2.6E-03 | 5.8E-09 |
| P1-068761-20 | P1-061029 HC: D30E_Y32E_A55E_N56E_G100H_F100fE | 7.45E+05 | 2.02E-03 | 2.71E-09 |
| P1-070864-3 | P1-068761_E30D | 4.4E+05 | 6.8E-03 | 1.5E-08 |
| P1-070890-3 | P1-068761_E30D_E55A | 3.9E+05 | 8.1E-03 | 2.1E-08 |
| P1-070868-6 | P1-068761_E55A | 4.3E+05 | 2.3E-03 | 5.4E-09 |
| P1-070878-3 | P1-068761_E55A_E56N | 1.9E+05 | 6.3E-03 | 3.3E-08 |
| P1-070870-3 | P1-068761_E56N | 2.0E+05 | 6.3E-03 | 3.2E-08 |
| P1-070900-3 | P1-068761_E56N_H100G | 5.0E+05 | 8.4E-03 | 1.7E-08 |
| P1-070872-4 | P1-068761_H100G | 6.8E+05 | 5.6E-03 | 8.2E-09 |
| P1-068767-22 | P1-061029 HC: D30E_N51D_A55E_F100fE_V102D | 4.38E+05 | 2.97E-03 | 6.78E-09 |
| P1-070906-6 | P1-068767_D52N | 3.1E+05 | 1.9E-03 | 6.0E-09 |
| P1-070916-6 | P1-068767_D52N_E55A | 3.0E+05 | 1.9E-03 | 6.5E-09 |
| P1-070904-3 | P1-068767_E30D | 2.3E+05 | 3.8E-03 | 1.7E-08 |
| P1-070914-3 | P1-068767_E30D_D52N | 2.3E+05 | 2.4E-03 | 1.1E-08 |
| P1-070922-3 | P1-068767_E30D_E55A | 2.3E+05 | 4.0E-03 | 1.7E-08 |
| P1-070908-6 | P1-068767_E55A | 2.7E+05 | 2.8E-03 | 1.0E-08 |
| P1-061015 | DSGFYSSYYFDY (SEQ ID NO: 95 Residues 99-110) | 2.47E+06 | 1.54E-03 | 6.22E-10 |
| P1-068744-7 | P1-061015 HC: S31E_150H_Y59E_S100E_Y102E | 8.6E+05 | 4.3E-03 | 5.1E-09 |
| P1-068748-6 | P1-061015 HC: S31HY32H_K57D_Y58D_S100D | 8.4E+05 | 3.6E-03 | 4.3E-09 |
| P1-061520-21 | 41F11 VK_A64G | 1.93E+06 | 3.23E-02 | 1.68E-08 |
| P1-070976-11 | 41F11_VH_T28P_Y50W_S55E_D95H_L96E_P97E_Y100E; Vk_A64G | 2.4E+05 | 2.3E-03 | 9.9E-09 |

Example 30: SPR Protocol for Assaying Anti-VISTA Antibody Binding to Human VISTA Binding affinity and binding kinetics of anti-VISTA antibodies to human VISTA (hVISTA) can be assayed by surface plasmon resonance (SPR) according to the following protocol. For these assays an hVISTA-ECD construct with a Histidine tag is used (SEQ ID NO: 325). Binding is measured at acidic and neutral pH on a Biacore® T200 instrument (GE Healthcare). Protein A (ThermoFisher cat. no. 21181) is diluted to 20 g/ml in 10 mM sodium acetate pH 4.5 and immobilized onto the flow cells of a CD5 biosensor following the manufacturer's amine coupling protocol (GE Healthcare). All SPR experiments are conducted at 37° C. using PBST (137 mM NaCl, 2.7 mM KCl, 10 mM phosphate buffer and 0.05% Tween® 20) running buffer at the indicated pH. Antibodies are diluted to 20 nM in PBST pH 7.4 and captured on the protein A surface. A concentration series of 100 to 0.8 nM monovalent human VISTA-ECD (SEQ ID NO: 325) is injected over the captured antibodies at 40 μl/min to measure association and dissociation. Two 15 s injections of 10 mM glycine pH 1.5 are used to regenerate the protein A capture surface between assay cycles. Rate constants $k_a$ ($k_{on}$, association rate) and $k_d$ ($k_{off}$, dissociation rate) are derived from reference flow cell and 0 nM blank-subtracted sensorgrams, and are fit to a 1:1 binding model in Biacore® T200 Evaluation Software version 3.1.

In further experiments, the h VISTA-ECD construct may captured on the protein A surface and the anti-VISTA antibodies injected over the captured protein. For use in this assay, an antibody Fab fragment is prepared by papain digest following the protocol of ThermoFisher cat. no. 44985. Binding of the Fab is performed using the same running buffer (PBST) at pH 7.4 and pH 6.0. The previously described hVISTA-ECD construct is diluted to 25 nM and captured for 60 seconds at 10 μl/min using an anti-human Fc CM5 sensor chip (GE Healthcare), following which the Fab is injected at a concentration ranging from 0.8 to 100 nM. The surface is regenerated using a 30 second pulse of 3M $MgCl_2$ at 30 μl/min. % Rmax (normalized SPR binding response) for Fab binding is calculated as (observed Rmax/calculated Rmin)×100, where observed Rmin=RU (binding response units) response at the end of the association phase; calculated Rmax=(capture level/molecular mass of ligand)×molecular mass of analyte.

Example 31: Cell Binding and Blocking Assay Protocol

Assays to determine whether and the degree to which an anti-VISTA antibody herein inhibits binding of h VISTA to a cell (wherein the cell is one to which hVISTA binds) may be performed according to the following protocols. In human VISTA binding and blocking assays, phycoerythrin (PE)-conjugated streptavidin multimers (Klickmers®, Immudex) are diluted to 32 nM in Hank's Buffered Salt Solution (HBSS, with calcium and magnesium) adjusted with 2-(N-morpholino) ethanesulfonic acid (MES) to the indicated pH. The diluted dextramers are loaded with 32-900 nM recombinant monobiotinylated human VISTA (ACRO Biosystems) to facilitate VISTA-dextramer capture. 'Empty' multimers that are not incubated with VISTA are used as a negative control. Human leukocytes, unstimulated peripheral blood mononuclear cells (PBMC) T cells, PBMC T cells stimulated for 72-96 hours with anti-CD3/CD28 bead stimulation (Human T-activator Dynabeads®, ThermoFisher), or Chinese Hamster Ovary (CHO) cells are labelled with VISTA multimers for 30 min at room temperature before washing with the same HBSS+MES buffers. Alternatively, cells are labelled with human VISTA-Fc chimeric proteins, and binding is detected with anti-IgG secondary antibodies (Jackson Immuno Research) diluted into the same HBSS+MES buffers. Labelled cells are left unfixed or fixed with formaldehyde (FoxP3 fixation buffer, eBioscience) and acquired on a flow cytometer.

In VISTA antibody blocking assays, 100 nM-loaded VISTA multimers or VISTA-Fc chimeric proteins are pre-incubated with the indicated antibodies before cell binding. In recombinant protein blocking assays, cells are pre-incubated with the indicated recombinant proteins before labelling with 100 nM-loaded VISTA multimers or VISTA-Fc chimeric proteins.

In PSGL-1 antibody blocking assays, cells are pre-incubated with KPL-1 (BD Biosciences or Biolegend) or PL2 (MBL) before labelling with 32 nM-loaded VISTA multimers or VISTA-Fc chimeric proteins. VISTA-Fc binding is detected by anti-IgG (Jackson Immuno Research) or 6×His (Columbia Biosciences) antibodies. Cells are acquired by flow cytometry or homogenous time resolved fluorescence (HTRF).

In mouse VISTA binding and blocking assays, mouse splenocytes and lymph node-resident cells are used directly ex vivo or first stimulated for 48 hours with anti-CD3/CD28 bead stimulation (Mouse T-activator Dynabeads, ThermoFisher). Cells are labelled with mouse VISTA-Fc chimeric proteins in pH 6.0 HBSS or PBS. VISTA-Fc, and binding is detected with anti-IgG secondary antibodies (Jackson Immuno Research). In antibody blocking assays, mouse VISTA-Fc is pre-incubated with VISTA. 10 antibody before cell labelling. Binding of VISTA to individual leukocyte subsets is determined by staining for CD4, CD8, B220 and CD11b (ThermoFisher). Cells are acquired on a flow cytometer.

In VSIG-3 binding assays, CHO and HEK293 cells are engineered to ectopically express human VSIG-3 and VISTA proteins, respectively. VSIG-3 expression can be confirmed by flow cytometry using anti-VSIG-3 (pAb AF4915, R&D Systems). VISTA expression can be confirmed by flow cytometry using anti-VISTA (clone 740804, R&D Systems). Cell binding assays are performed in PBS buffers containing 0.9 mM $CaCl_2$, 0.05 mM $MgCl_2$ and 0.5% BSA adjusted to the desired pH by varying the ratios of $Na_2HPO_4$ and $KH_2PO_4$ in the buffer. VISTA-Fc and VSIG-3-Fc are used at 10 μg/ml. Binding is detected with anti-human IgG $(Fab')_2$-PE (Invitrogen).

Example 32: Antibody Epitope Binning Competition Assay and pH Sensitivity Protocol Competitive SPR epitope binning is used to identify VISTA-specific antibodies which cross-block the desired VISTA antibody epitope (e.g. of VISTA.4 or P1-068767) or undesired VISTA antibody epitope (e.g. of anti-VISTA antibody VISTA.5) using a Biacore® T200 instrument. Test and control antibodies are diluted to 10 μg/mL in 10 mM sodium acetate pH 4.5 and immobilized onto the flow cells of a CM5 biosensor following the manufacturer's amine coupling protocol (GE Healthcare). Competition is assessed at 25° C. using HBS-P+ running buffer (10 mM HEPES, 150 mM NaCl and 0.05% v/v Surfactant P20, pH 7.4). 100 nM monovalent human his-tagged VISTA ECD (SEQ ID NO: 325) is captured by the immobilized antibodies, then each antibody screened is injected at 100 nM to evaluate co-binding or blocking activity against a second anti-VISTA antibody such as VISTA.4 or VISTA.5. Two 30 second injections of 10 mM glycine pH 2.0 are used to regenerate surfaces of the second anti-VISTA antibody (e.g. VISTA.4 or VISTA.5) between assay cycles. Sensorgrams are analyzed using Biacore® T200 Evaluation Software version 2.0. Antibodies blocked (for example by VISTA.4 or P1-068767) and those that are not blocked, i.e. that have a different epitope, can also be assessed for pH-dependent VISTA binding in this assay at pH 7.4 and 6.0.

Example 33: SPR Binding Kinetics of P1-068744 and P1-068748 Reversion Mutant Antibodies To determine which of the amino acid changes made in the heavy chain CDRs of P1-068744 (SEQ ID NO: 103) and P1-068748 (SEQ ID NO: 99) relative to those of P1-061015 (SEQ ID NO: 95) are necessary for maintaining high affinity binding to human VISTA and important for conferring acidic pH-selective properties, reversion mutants of P1-068744 and P1-068748 were made, and their binding kinetics tested by SPR at pH 6.0 and at pH 7.4. An alignment of the amino acid sequences of the heavy chain CDRs of P1-068744, P1-068748 and P1-061015 is shown, e.g., in Table 8 above and in FIG. 29C.

P1-068744 heavy chain compares to that of its parental antibody P1-061015 (compare SEQ ID Nos: 95 and 103) in that P1-068744 contains several basic amino acid residues in the heavy chain CDRs (see Tables 8, 11 and 27 and compare SEQ ID Nos: 95 and 103). Based on SEQ ID Nos: 95 and 103, P1-068744 contains an E residue at position 31 in the heavy chain CDR1 rather than an S, an H residue at position 50 in the heavy chain CDR2 rather than an I, an E at position 60 of heavy chain CDR2 instead of a Y (a reversion of this change is called herein E59Y), an E at position 104 in heavy chain CDR3 rather than an S (a reversion of this change is called herein E100S), and an E at position 110 of heavy chain CDR3 (the final position of CDR3) rather than a Y (a reversion of this change is called herein E102Y).

The SPR assay was conducted at 37° C. in PBST running buffer at pH 6.0 or 7.4, and included the following steps: a 30 second antibody capture on Protein A chip at 10 μL/min flow; a 180 second sample injection at 40 μL/min, then 600 second dissociation; 2×15 second regeneration injections with glycine 1.5 at 30 μL/min. The results are set forth in FIG. 29A and Table 27.

Figure 29B:
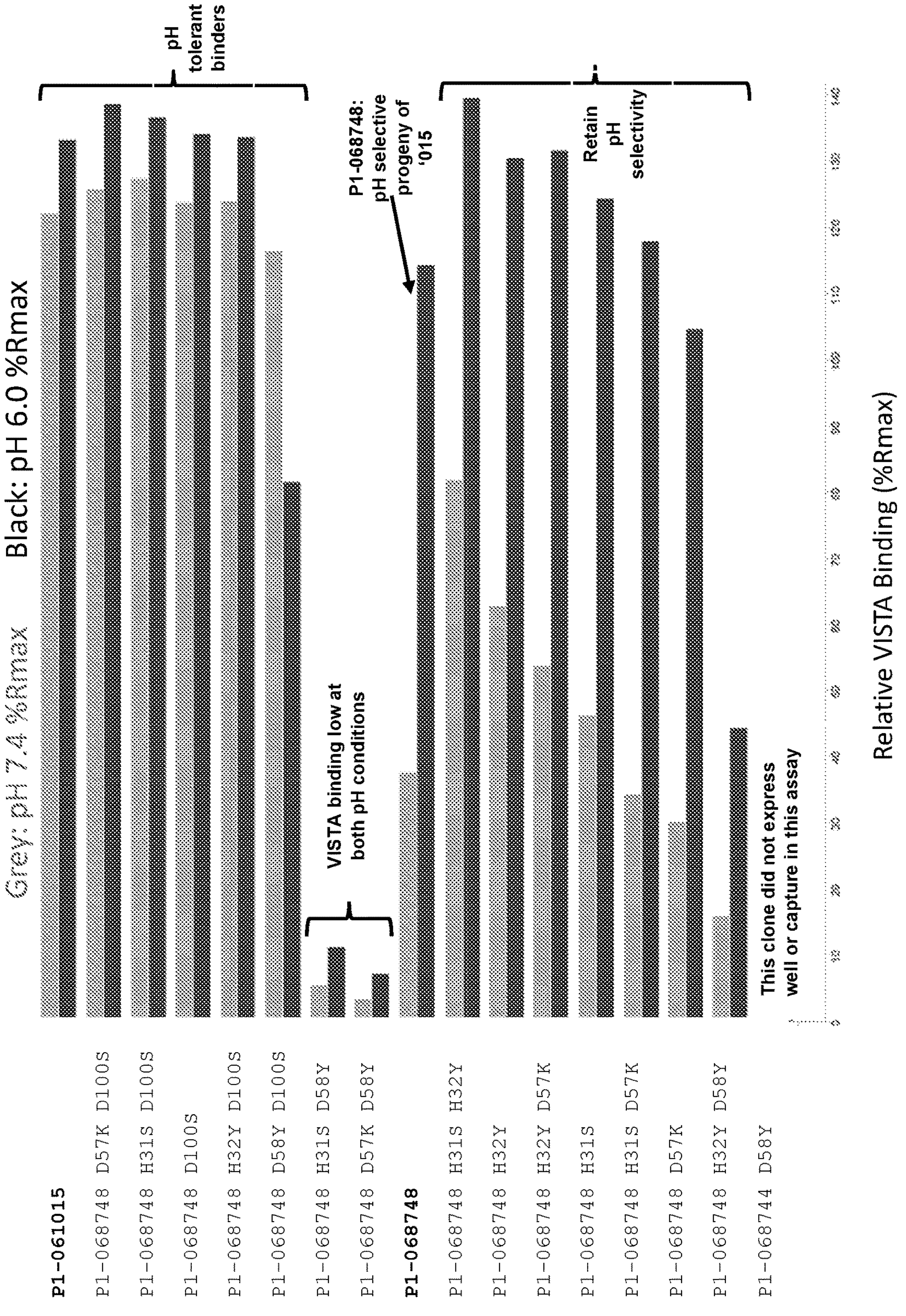

The P1-068748 heavy chain compares to that of antibody P1-061015, as shown in Tables 8, 12 and 28 (and compare SEQ ID Nos. 95 and 99), in that it also contains several basic residues in the heavy chain CDRs. Specifically, comparing SEQ ID Nos: 95 and 99, P1-068748 contains H residues at positions 31 and 32 of CDR1, D residues at positions 58 and 59 of CDR2 (revertants are called D57K and D58Y herein), and a D residue at position 104 of CDR3 (revertants of this change are called D100S herein). The SPR experiments were conducted as set forth above for the P1-068744 reversion mutants. The results for the P1-068748 reversion mutant antibodies are set forth in FIG. 29B and in Table 28.

TABLE 27

Binding kinetics of P1-061015 and P1-068744 reversion mutants.

| P1 ID | Reversion mutation(s) | 7.4 ka (1/Ms) | 7.4 kd (1/s) | 7.4 KD (M) | 7.4 Ligand Level (RU) | 7.4 %Rmax | HCDR1 | HCDR2 | HCDR3 |
|---|---|---|---|---|---|---|---|---|---|
| P1-061015 | | 3.4E+05 | 2.2E-03 | 6.4E-09 | 712 | 122 | GFTFSSYAMH (SEQ ID NO: 95 Residues 26-35) | IIWYDGSNKYY-ADSVKG (SEQ ID NO: 95 Residues 50-66) | DSGFYSSYYFDY (SEQ ID NO: 95 Residues 99-110) |
| P1-077835 | E31S | 3.9E+04 | 2.6E-02 | 6.6E-07 | 549 | 31 | .......... | H.........E...... | .....E.....E |
| P1-077853 | E31S E102Y | 2.1E+04 | 2.4E-02 | 1.2E-06 | 484 | 25 | .......... | H.........E...... | .....E...... |
| P1-077845 | E31S H501 | 2.8E+05 | 3.8E-03 | 1.4E-08 | 547 | 122 | .......... | ..........E...... | .....E.....E |
| P1-077861 | H501 E102Y | 1.0E+05 | 2.7E-03 | 2.6E-08 | 507 | 112 | .....E.... | ..........E...... | .....E...... |
| P1-077837 | H501 | 1.3E+05 | 3.3E-03 | 2.6E-08 | 541 | 112 | .....E.... | ..........E...... | .....E.....E |
| P1-077859 | H501 E100S | 4.6E+05 | 4.4E-03 | 9.5E-09 | 590 | 121 | .....E.... | ..........E...... | ...........E |
| P1-077847 | H501 E59Y | 1.2E+05 | 3.5E-03 | 2.9E-08 | 677 | 109 | .....E.... | ..........E...... | .....E.....E |
| P1-068744 | | 3.5E+04 | 3.6E-02 | 1.1E-06 | 565 | 17 | .....E.... | H.........E...... | .....E.....E |
| P1-077843 | E102Y | 1.8E+04 | 3.4E-02 | 2.0E-06 | 576 | 13 | .....E.... | H.........E...... | .....E...... |
| P1-077855 | E31S E59Y | 1.2E+04 | 6.1E-02 | 5.2E-06 | 689 | 11 | .......... | H................ | .....E.....E |
| P1-077863 | E59Y E102Y | 6.3E+04 | 5.5E-02 | 1.1E-06 | 666 | 7 | .....E.... | H................ | .....E...... |
| P1-077839 | E59Y | 7.1E+04 | 9.3E-02 | 1.3E-06 | 671 | 8 | .....E.... | H................ | .....E.....E |
| P1-077851 | E100S E102Y | 1.5E+05 | 3.0E-01 | 2.2E-06 | 558 | 20 | .....E.... | H.........E...... | ............ |
| P1-077857 | E31S E100S | 3.0E+05 | 1.6E-01 | 5.2E-07 | 628 | 38 | .......... | H.........E...... | ...........E |
| P1-077841 | E100S | 3.3E+05 | 3.0E-01 | 9.1E-07 | 543 | 21 | .....E.... | H.........E...... | ...........E |
| P1-077849 | E59Y E100S | 5.3E+04 | 3.5E-01 | 6.6E-06 | 569 | 14 | .....E.... | H................ | ...........E |

| P1 ID | Reversion mutation(s) | 6.0 ka (1/Ms) | 6.0 kd (1/s) | 6.0 KD (M) | 6.0 Ligand Level (RU) | 6.0 %Rmax | HCDR1 | HCDR2 | HCDR3 |
|---|---|---|---|---|---|---|---|---|---|
| P1-061015 | | 8.3E+05 | 1.6E-03 | 1.9E-09 | 967 | 133 | GFTFSSYAMH (SEQ ID NO: 95 Residues 26-35) | IIWYDGSNKYY-ADSVKG (SEQ ID NO: 95 Residues 50-66) | DSGFYSSYYFDY (SEQ ID NO: 95 Residues 99-110) |
| P1-077835 | E31S | 2.2E+05 | 1.7E-03 | 7.7E-09 | 763 | 123 | .......... | H.........E...... | .....E.....E |
| P1-077853 | E31S E102Y | 1.1E+05 | 1.9E-03 | 1.8E-08 | 690 | 104 | .......... | H.........E...... | .....E...... |
| P1-077845 | E31S H501 | 1.2E+06 | 2.0E-03 | 1.7E-09 | 743 | 141 | .......... | ..........E...... | .....E.....E |
| P1-077861 | H501 E102Y | 8.7E+05 | 2.3E-03 | 2.6E-09 | 718 | 137 | .....E.... | ..........E...... | .....E...... |
| P1-077837 | H501 | 1.2E+06 | 3.0E-03 | 2.5E-09 | 750 | 136 | .....E.... | ..........E...... | .....E.....E |
| P1-077859 | H501 E100S | 1.4E+06 | 3.2E-03 | 2.3E-09 | 821 | 135 | .....E.... | ..........E...... | ...........E |
| P1-077847 | H501 E59Y | 1.2E+06 | 3.2E-03 | 2.7E-09 | 903 | 132 | .....E.... | ..........E...... | .....E.....E |

TABLE 27-continued

Binding kinetics of P1-061015 and P1-068744 reversion mutants.

| | | | | | | | | |
|---|---|---|---|---|---|---|---|---|
| P1-068744 | | 2.3E+05 | 4.6E-03 | 2.0E-08 | 788 | 106 | .....E....H.........E...... | .....E.....E |
| P1-077843 | E102Y | 1.5E+05 | 4.8E-03 | 3.3E-08 | 797 | 90 | .....E....H.........E...... | .....E...... |
| P1-077855 | E31S E59Y | 2.1E+05 | 7.7E-03 | 3.6E-08 | 1007 | 82 | ..........H................ | .....E.....E |
| P1-077863 | E59Y E102Y | 1.4E+05 | 1.7E-02 | 1.3E-07 | 947 | 47 | .....E....H................ | .....E...... |
| P1-077839 | E59Y | 6.3E+05 | 5.4E-02 | 8.5E-08 | 899 | 59 | .....E....H................ | .....E.....E |
| P1-077851 | E100S E102Y | 3.8E+05 | 8.5E-02 | 2.2E-07 | 776 | 30 | .....E....H.........E...... | .....E...... |
| P1-077857 | E31S E100S | 8.2E+05 | 9.7E-02 | 1.2E-07 | 915 | 44 | ..........H.........E...... | ...........E |
| P1-077841 | E100S | 5.2E+05 | 1.1E-01 | 2.0E-07 | 752 | 33 | .....E....H.........E...... | ...........E |
| P1-077849 | E59Y E100S | 5.0E+05 | 1.1E-01 | 2.2E-07 | 783 | 24 | .....E....H................ | ...........E |

TABLE 28

Binding kinetics of P1-061015 and P1-068748 reversion mutants.

| P1 ID | Reversion mutation (s) | 7.4 ka (1/Ms) | 7.4 kd (1/s) | 7.4 KD (M) | 7.4 Ligand Level (RU) | 7.4 %Rmax | HCDR1 | HCDR2 | HCDR3 |
|---|---|---|---|---|---|---|---|---|---|
| P1-077893 | D57K D100S | 4.0E+05 | 1.9E-03 | 4.7E-09 | 640 | 126 | .....HH... | .........D....... | ............ |
| P1-077891 | H32Y D100S | 1.2E+06 | 2.5E-03 | 2.1E-09 | 550 | 124 | .....H.... | ........DD....... | ............ |
| P1-077887 | H31S D100S | 9.1E+05 | 2.7E-03 | 3.0E-09 | 493 | 127 | ......H... | ........DD....... | ............ |
| P1-077873 | D100S | 8.5E+05 | 3.0E-03 | 3.6E-09 | 589 | 124 | .....HH... | ........DD....... | ............ |
| P1-061015 | | 3.4E+05 | 2.2E-03 | 6.4E-09 | 712 | 122 | GFTFSSYAMH (SEQ ID NO: 95 Residues 26-35) | IIWYDGSNKYYADSVKG (SEQ ID NO: 95 Residues 50-66) | DSGFYSSYYFDY (SEQ ID NO: 95 Residues 99-110) |
| P1-077875 | H31S H32Y | 1.6E+05 | 2.1E-02 | 1.3E-07 | 521 | 82 | .......... | ........DD....... | .....D...... |
| P1-077877 | H32Y D57K | 8.8E+04 | 2.4E-02 | 2.7E-07 | 714 | 54 | .....H.... | .........D....... | .....D...... |
| P1-077883 | H31S D57K | 6.8E+04 | 3.5E-02 | 5.1E-07 | 688 | 34 | ......H... | .........D....... | .....D...... |
| P1-077869 | D57K | 2.8E+04 | 2.7E-02 | 9.8E-07 | 588 | 30 | .....HH... | .........D....... | .....D...... |
| P1-077865 | H31S | 6.9E+04 | 2.8E-02 | 4.1E-07 | 525 | 46 | ......H... | ........DD....... | .....D...... |
| P1-077867 | H32Y | 1.2E+05 | 2.6E-02 | 2.3E-07 | 625 | 63 | .....H.... | ........DD....... | .....D...... |
| P1-077881 | D58Y D100S | 1.6E+05 | 3.6E-03 | 2.2E-08 | 511 | 116 | .....HH... | ........D........ | ............ |
| P1-068748 | | 5.4E+04 | 3.2E-02 | 6.0E-07 | 574 | 38 | .....HH... | ........DD....... | .....D...... |
| P1-077889 | H32Y D58Y | 3.1E+04 | 7.3E-02 | 2.4E-06 | 589 | 16 | .....H.... | ........D........ | .....D...... |
| P1-077871 | D58Y | Not vaptured/analyzed | | | 0 | 0 | .....HH... | ........D....... | .....D...... |
| P1-077879 | D57K D58Y | Not fit | | | 600 | 3 | .....HH... | ................. | .....D...... |
| P1-077885 | H31S D58Y | Not fit | | | 510 | 5 | ......H... | ........D........ | .....D...... |

TABLE 28-continued

Binding kinetics of P1-061015 and P1-068748 reversion mutants.

| P1 ID | Reversion mutation (s) | 6.0 ka (1/Ms) | 6.0 kd (1/s) | 6.0 KD (M) | 6.0 Ligand Level (RU) | 6.0 %Rmax | HCDR1 | HCDR2 | HCDR3 |
|---|---|---|---|---|---|---|---|---|---|
| P1-077893 | D57K D100S | 1.4E+06 | 5.8E-04 | 4.3E-10 | 900 | 138 | .....HH... | .........D....... | ............ |
| P1-077891 | H32Y D100S | 2.7E+06 | 9.9E-04 | 3.6E-10 | 795 | 133 | .....H.... | ........DD....... | ............ |
| P1-077887 | H31S D100S | 2.1E+06 | 1.1E-03 | 5.2E-10 | 716 | 136 | ......H... | ........DD....... | ............ |
| P1-077873 | D100S | 1.8E+06 | 1.2E-03 | 7.1E-10 | 822 | 134 | .....HH... | ........DD....... | ............ |
| P1-061015 | | 8.3E+05 | 1.6E-03 | 1.9E-09 | 967 | 133 | GFTFSSYAMH (SEQ ID NO: 95 Residues 26-35) | IIWYDGSNKYYADSVKG (SEQ ID NO: 95 Residues 50-66) | DSGFYSSYYFDY (SEQ ID NO: 95 Residues 99-110) |
| P1-077875 | H31S H32Y | 1.9E+06 | 1.8E-03 | 9.4E-10 | 745 | 139 | .......... | ........DD....... | .....D...... |
| P1-077877 | H32Y D57K | 8.4E+05 | 1.9E-03 | 2.2E-09 | 963 | 131 | .....H.... | .........D....... | .....D...... |
| P1-077883 | H31S D57K | 3.1E+05 | 2.0E-03 | 6.7E-09 | 920 | 118 | ......H... | .........D....... | .....D...... |
| P1-077869 | D57K | 1.7E+05 | 2.6E-03 | 1.5E-08 | 772 | 104 | .....HH... | .........D....... | .....D...... |
| P1-077865 | H31S | 5.4E+05 | 2.8E-03 | 5.2E-09 | 744 | 124 | ......H... | ........DD....... | .....D...... |
| P1-077867 | H32Y | 1.3E+06 | 2.9E-03 | 2.2E-09 | 831 | 130 | .....H.... | ........DD....... | .....D...... |
| P1-077881 | D58Y D100S | 6.2E+04 | 3.4E-03 | 5.3E-08 | 719 | 81 | .....HH... | ........D........ | .....D...... |
| P1-068748 | | 3.1E+05 | 3.5E-03 | 1.1E-08 | 780 | 114 | .....HH... | ........DD....... | .....D...... |
| P1-077889 | H32Y D58Y | 1.8E+05 | 2.2E-02 | 1.3E-07 | 852 | 44 | .....H.... | ........D........ | .....D...... |
| P1-077871 | D58Y | Not captured/analyzed | | | 0 | 0 | .....HH... | ........D........ | .....D...... |
| P1-077879 | D57K D58Y | Not fit | | | 815 | 7 | .....HH... | ................. | .....D...... |
| P1-077885 | H31S D58Y | Not fit | | | 701 | 11 | ......H... | ........D........ | .....D...... |

FIG. 29C shows a summary of the results as an alignment of the antibody heavy chain CDRs. The delineated amino acid residues of P1-068744 and P1-068748 that are bolded are those whose reversion back to the corresponding residues in P1-061015 maintained pH selectivity and improved the ka at pH 6.0 compared to the P1-068744 or P1-068748 antibody. The amino acid residues that have a double underline are those whose reversion back to the corresponding residues in P1-061015 caused a loss of pH selectivity of P1-068744 or P1-068748, and are therefore important residues in these antibodies for pH selective binding to hVISTA. The amino acid residues with jagged underlining are those whose reversion back to the corresponding residues in P1-061015 was detrimental to kinetics and/or binding of P1-068744 or P1-068748 to hVISTA, and are therefore important residues in these antibodies for binding to hVISTA. In particular, P1-068744 reversion mutants that included the H50I reversion were pH tolerant like the P1-061015 antibody. The P1-068744 E31S mutation maintains pH selective properties and has an improved off-rate (about 2-3 fold) at pH 6.0 relative to the '744 antibody. When the E31S mutation is combined with E59Y or E100S, the improved off-rate is lost. E59Y and E100S reversions appear detrimental to kinetics. P1-068748 reversion mutants that included the D100S reversion were pH tolerant like the P1-061015 parent antibody. The H31S, H32Y, and D57K reversions, alone or in double substitutions, maintained pH selectivity and had a slightly (≤2 fold) improved off-rate at pH 6.0 compared to the '748 antibody. P1-068748 double reversion mutants that included the D58Y reversion showed poor binding and/or poor kinetics. The single D58Y reversion mutant was not expressed and could not be evaluated.

Example 34: Binding of Anti-hVISTA Antibodies to Cells Expressing hVISTA-ECD

To test binding of anti-hVISTA antibodies to 293T cells stably expressing a hVISTA extracellular domain (ECD) at pH 6.0 and pH 7.4, the following protocol was used. Acidic (pH 6.0) and neutral (pH 7.4) HBSS buffers were adjusted to the correct pH by adding MES dropwise into solution until the desired pH was reached. 293-OKT3-VISTA expressing cells were plated on a 96-well plate at about 40,000 cells/well. Cells were washed with the respective pH buffer. Antibodies (at 10 μg/ml) were added to the wells of the plates and the plates were incubated on ice for 45 minutes, then washed two times with the respective buffer. An APC conjugated anti-human IgG secondary antibody was then added at a 1:200 ratio (e.g. APC goat anti-human) and the plates were incubated on ice for a further 45 minutes and then washed two times with the respective buffer. Fluorescense was then read on a flow cytometer.

Figure 30A:
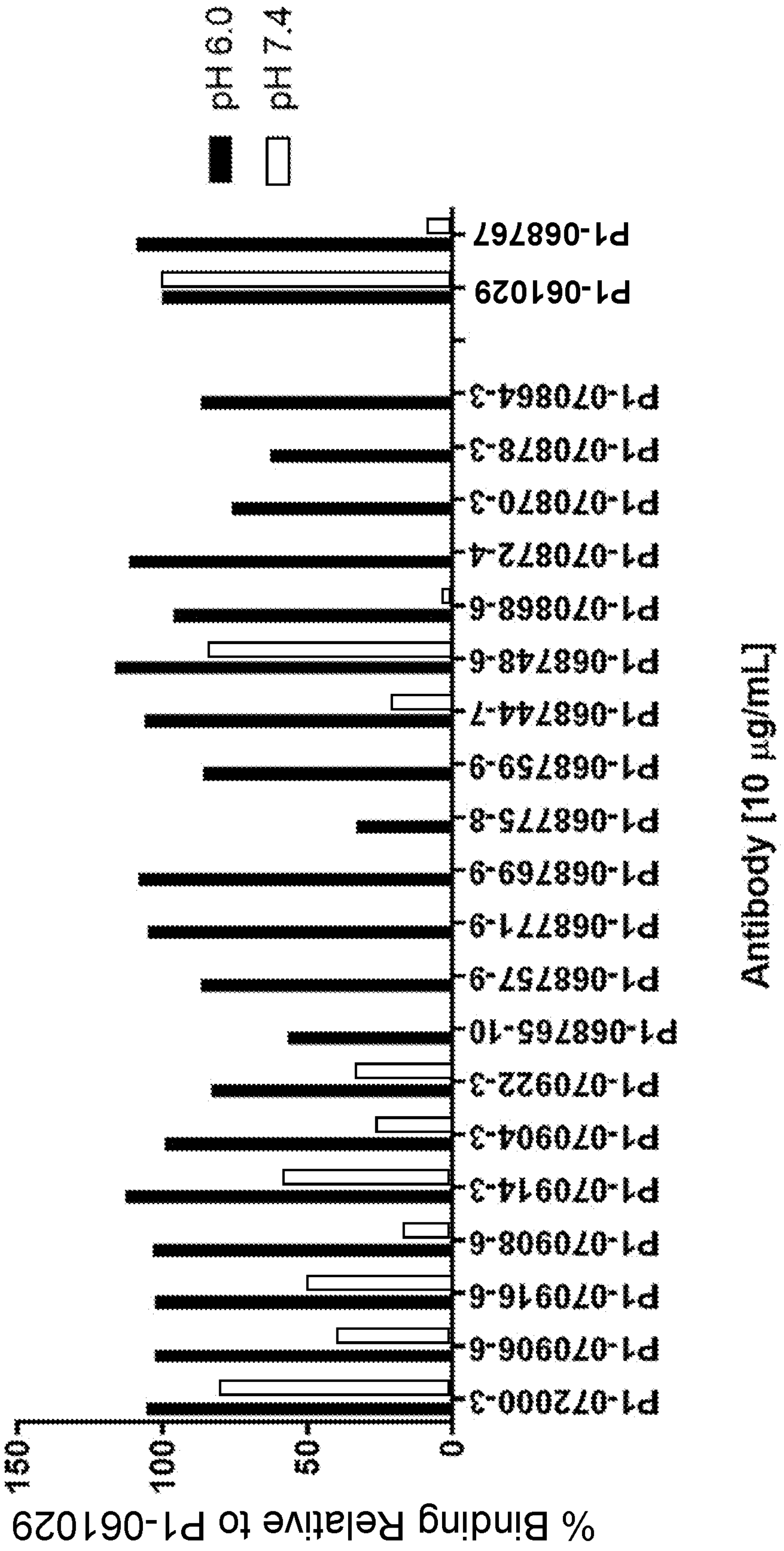
FIG. 30A-D show results from tests of binding of anti-h VISTA antibodies (10 μg/ml) to 293T cells engineered to express hVISTA extracellular domain in HBSS/MES buffer at pH 6.0 (black bars) and pH 7.4 (white bars). Results are shown as percent binding normalized against binding of P1-061029, which is set to 100%.
Figure 30B:
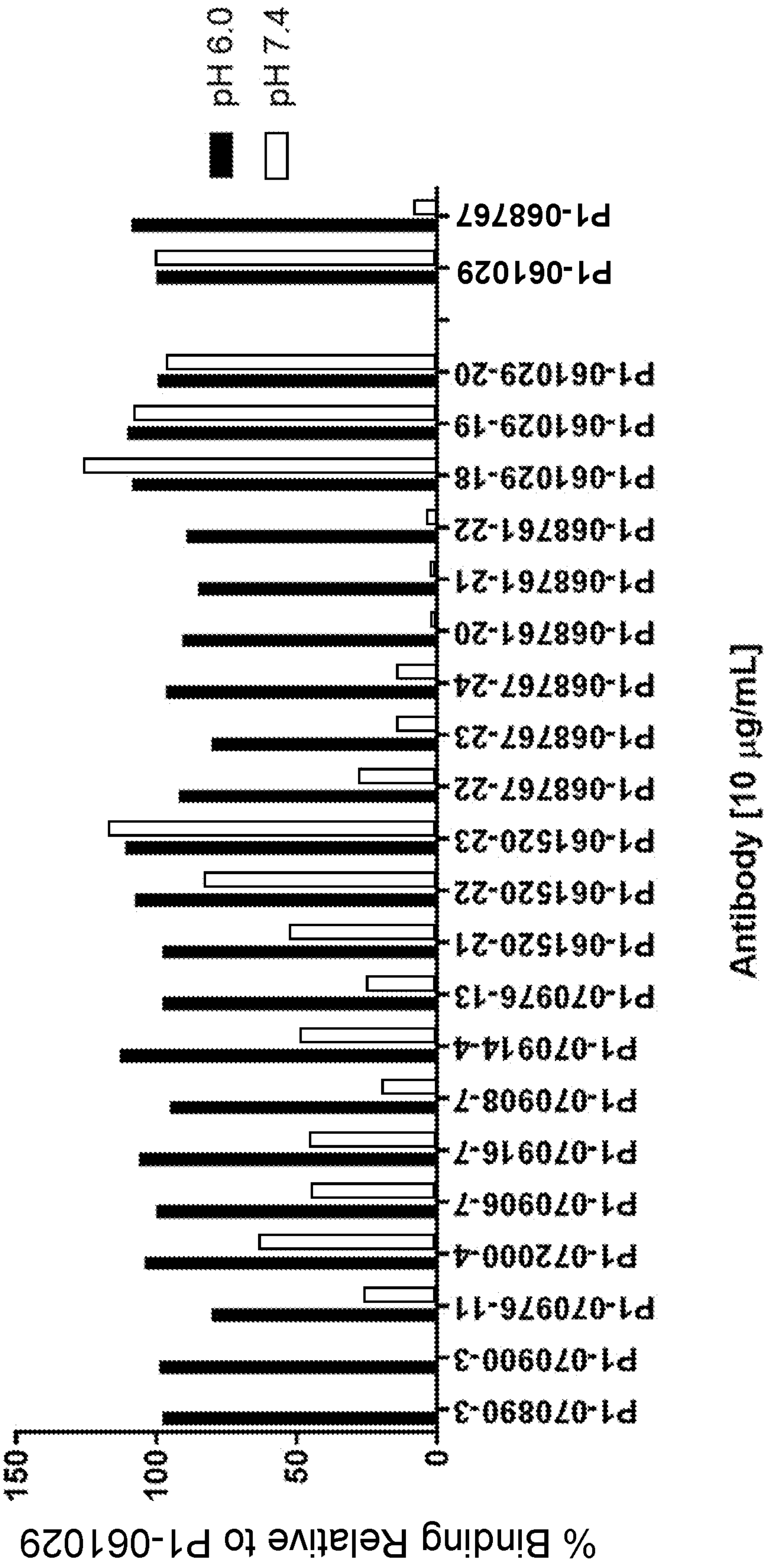
Figure 30C:
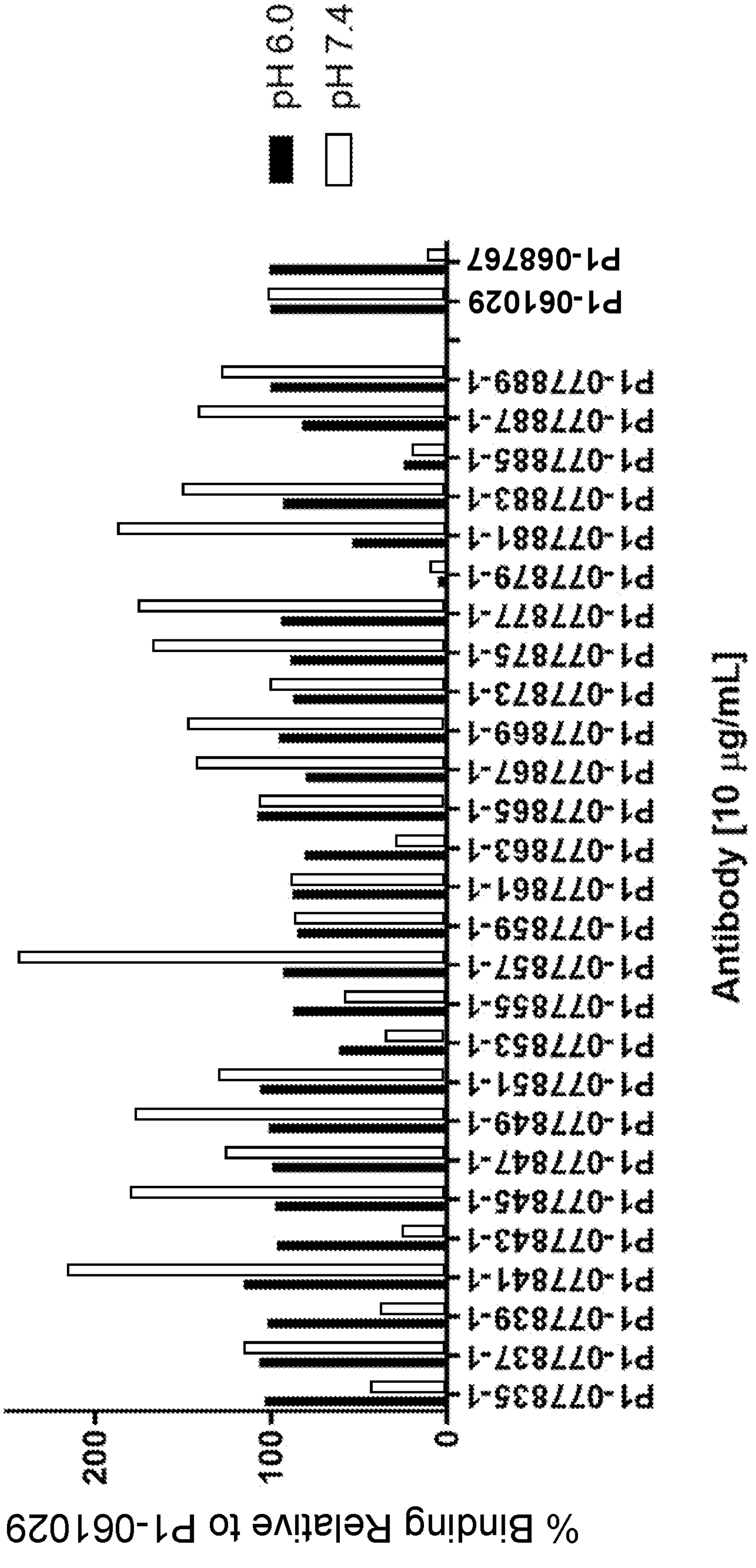
Figure 30D:
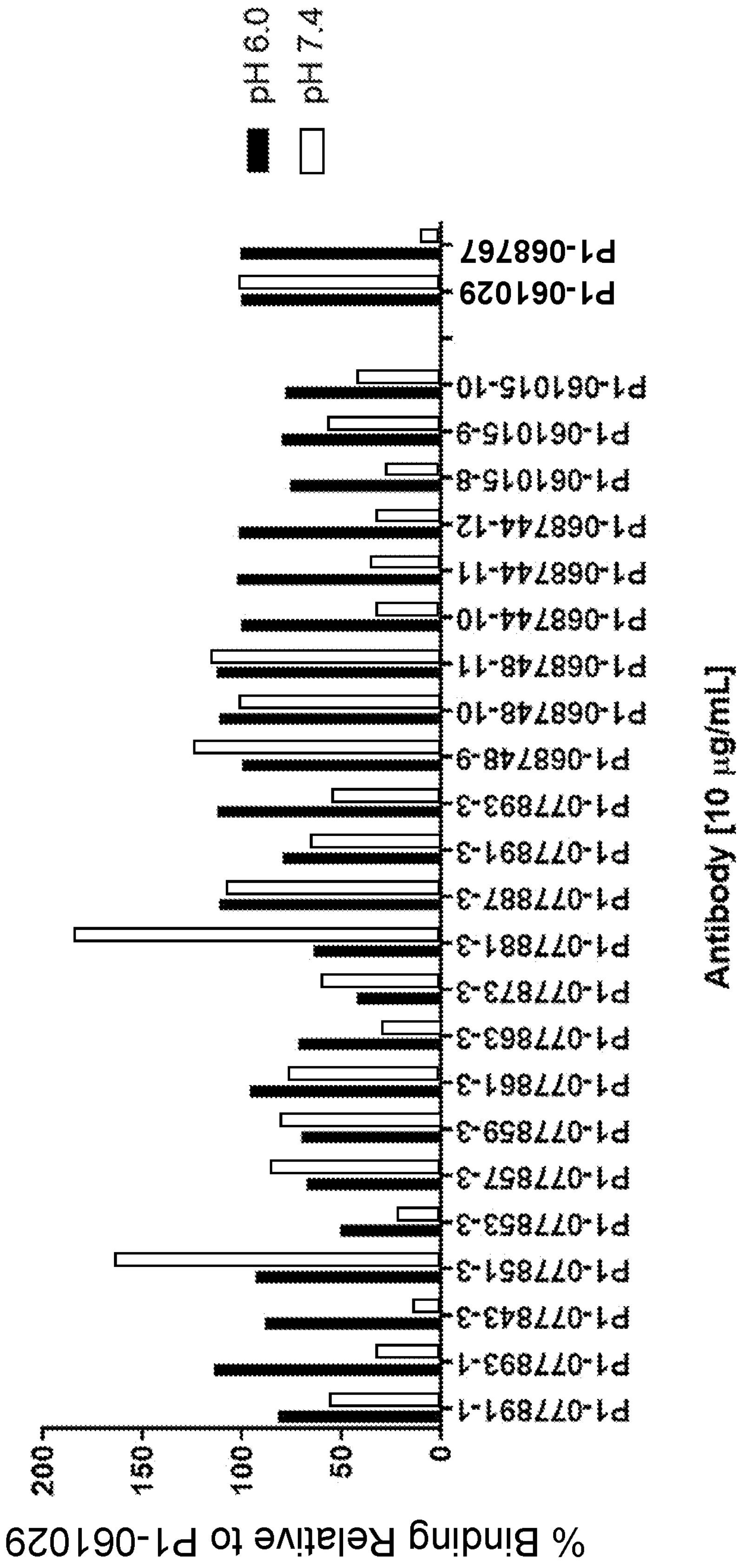

Data from this experiment are shown in FIG. 30A-D and are displayed as percentage binding in comparison to binding of antibody P-061029 at each pH, which is set to 100%. None of the antibodies tested showed any binding to 293T parent cells that do not express hVISTA. FIG. 30A shows data for the P1-068744 and P1-068748 antibodies as well as antibody P1-068767, P1-061029, and several of their progeny antibodies. FIG. 30B shows data for additional P1-068767 or P1-061029 progeny antibodies and for several VISTA.4 progeny antibodies. FIGS. 30C and 30D show data for various P1-068744 and P1-068748 progeny antibodies.

Sequence Table

The following is a table of certain sequences referred to in this application. In SEQ ID NO: 2, amino acid position 187 may be either a D or an E.

In the antibody sequences below, the VH CDR1, CDR2, and CDR3 sequences are located at amino acid positions comprising amino acids 26-35, 50-66, and 99-110, respectively, and the VL CDR1, CDR2, and CDR3 sequences are located at amino acid positions comprising amino acids 24-35, 51-57, and 90-98, respectively. The VH CDR1 is numbered according to AbM (AA 26-35; Abhinandan and Martin (2008) Mol. Immunol. 45:3832-3839; Swindells et al. (2017) J. Mol. Biol. 429:356-364) and all other CDRs (VH CDR2, VH CDR3, VL CDR1-3) are numbered according to Kabat. The CDR sequences of particular antibody species are bold and underlined below on their VH and VL sequences.

| SEQ ID NO | Name | Sequence |
|---|---|---|
| 1 | hVISTA (with leader sequence) | MGVPTALEAG SWRWGSLLFA LFLAASLGPV AAFKVATPYS<br>LYVCPEGQNV TLTCRLLGPV DKGHDVTFYK TWYRSSRGEV<br>QTCSERRPIR NLTFQDLHLH HGGHQAANTS HDLAQRHGLE<br>SASDHHGNFS ITMRNLTLLD SGLYCCLVVE IRHHHSEHRV<br>HGAMELQVQT GKDAPSNCVV YPSSSQDSEN ITAAALATGA<br>CIVGILCLPL ILLLVYKQRQ AASNRRAQEL VRMDSNIQGI<br>ENPGFEASPP AQGIPEAKVR HPLSYVAQRQ PSESGRHLLS<br>EPSTPLSPPG PGDVFFPSLD PVPDSPNFEV I |
| 2 | hVISTA (no leader sequence) | FKVATPYSLY VCPEGQNVTL TCRLLGPVDK GHDVTFYKTW<br>YRSSRGEVQT CSERRPIRNL TFQDLHLHHG GHQAANTSHD<br>LAQRHGLESA SDHHGNFSIT MRNLTLLDSG LYCCLVVEIR<br>HHHSEHRVHG AMELQVQTGK DAPSNCVVYP SSSQ[D/E]SENIT<br>AAALATGACI VGILCLPLIL LLVYKQRQAA SNRRAQELVR<br>MDSNIQGIEN PGFEASPPAQ GIPEAKVRHP LSYAQRQPS<br>ESGRHLLSEP STPLSPPGPG DVFFPSLDPV PDSPNFEVI |
| 3 | Human PSGL-1 isoform 2 precursor, with signal peptide | MPLQLLLLLI LLGPGNSLQL WDTWADEAEK ALGPLLARDR<br>RQATEYEYLD YDFLPETEPP EMLRNSTDTT PLTGPGTPES<br>TTVEPAARRS TGLDAGGAVT ELTTELANMG NLSTDSAAME<br>IQTTQPAATE AQTTQPVPTE AQTTPLAATE AQTTRITATE<br>AQTTPLAATE AQTTPPAATE AQTTQPTGLE AQTTAPAAME<br>AQTTAPAAME AQTTPPAAME AQTTQTTAME AQTTAPEATE<br>AQTTQPTATE AQTTPLAAME ALSTEPSATE ALSMEPTTKR<br>GLFIPFSVSS VTHKGIPMAA SNLSVNYPVG APDHISVKQC<br>LLAILILALV ATIFFVCTVV LAVRLSRKGH MYPVRNYSPT<br>EMVCISSLLP DGGEGPSATA NGGLSKAKSP GLTPEPREDR<br>EGDDLTLHSF LP |
| 4 | Human PSGL-1 isoform 2, without signal peptide | LQL WDTWADEAEK ALGPLLARDR<br>RQATEYEYLD YDFLPETEPP EMLRNSTDTT PLTGPGTPES<br>TTVEPAARRS TGLDAGGAVT ELTTELANMG NLSTDSAAME<br>IQTTQPAATE AQTTQPVPTE AQTTPLAATE AQTTRLTATE<br>AQTTPLAATE AQTTPPAATE AQTTQPTGLE AQTTAPAAME<br>AQTTAPAAME AQTTPPAAME AQTTQTTAME AQTTAPEATE<br>AQTTQPTATE AQTTPLAAME ALSTEPSATE ALSMEPTTKR<br>GLFIPFSVSS VTHKGIPMAA SNLSVNYPVG APDHISVKQC<br>LLAILILALV ATIFFVCTVV LAVRLSRKGH MYPVRNYSPT<br>EMVCISSLLP DGGEGPSATA NGGLSKAKSP GLTPEPREDR<br>EGDDLTLHSF LP |
| 5 | Human PSGL-1 isoform 2 ECD, with signal peptide | MPLQLLLLLI LLGPGNSLQL WDTWADEAEK ALGPLLARDR<br>RQATEYEYLD YDELPETEPP EMLRNSTDTT PLTGPGTPES<br>TTVEPAARRS TGLDAGGAVT ELTTELANMG NLSTDSAAME<br>IQTTQPAATE AQTTQPVPTE AQTTPLAATE AQTTRLTATE<br>AQTTPLAATE AQTTPPAATE AQTTQPTGLE AQTTAPAAME<br>AQTTAPAAME AQTTPPAAME AQTTQT |

-continued

| SEQ ID NO | Name | Sequence |
|---|---|---|
| 6 | Human PSGL-1 isoform 2 ECD, without signal peptide | LQL WDTWADEAEK ALGPLLARDR RQATEYEYLD<br>YDFLPETEPP EMLRNSTDTT PLTGPGTPES TTVEPAARRS<br>TGLDAGGAVT ELTTELANMG NLSTDSAAME IQTTQPAATE<br>AQTTQPVPTE AQTTPLAATE AQTTRLTATE AQTTPLAATE<br>AQTTPPAATE AQTTQPTGLE AQTTAPAAME AQTTAPAAME<br>AQTTPPAAME AQTTQT |
| 7 | Human PSGL-1 ECD (N-terminal positions 42 to 295 of a full length Human PSGL-1 Accession No. AAC50061) | QATEYEYLD YDELPETEPP EMLRNSTDTT PLTGPGTPES<br>TTVEPAARRS TGLDAGGAVT ELTTELANMG NLSTDSAAME<br>IQTTQPAATE AQTTPLAATE AQTTRLTATE AQTTPLAATE<br>AQTTPPAATE AQTTQPTGLE AQTTAPAAME AQTTAPAAME<br>AQTTPPAAME AQTTQTTAME AQTTAPEATE AQTTQPTATE<br>AQTTPLAAME ALSTEPSATE ALSMEPTTKR GLFIPFSVSS<br>VTHKGIPMAA SNLSV |
| 8 | HumPSGL-1 isoform 1 precursor, with signal peptide NP_001193538 | MAVGASGLEG DKMAGAMPLQ LLLLLILLGP GNSLQLWDTW<br>ADEAEKALGP LLARDRRQAT EYEYLDYDEL PETEPPEMLR<br>NSTDTTPLTG PGTPESTTVE PAARRSTGLD AGGAVTELTT<br>ELANMGNLST DSAAMEIQTT QPAATEAQTT QPVPTEAQTT<br>PLAATEAQTT RLTATEAQTT PLAATEAQTT PPAATEAQTT<br>QPTGLEAQTT APAAMEAQTT APAAMEAQTT PPAAMEAQTT<br>QTTAMEAQTT APEATEAQTT QPTATEAQTT PLAAMEALST<br>EPSATEALSM EPTTKRGLFI PFSVSSVTHK GIPMAASNLS<br>VNYPVGAPDH ISVKQCLLAI LILALVATIF FVCTVVLAVR<br>LSRKGHMYPV RNYSPTEMVC ISSLLPDGGE GPSATANGGL<br>SKAKSPGLTP EPREDREGDD LTLHSFLP |
| 9 | Human PSGL-1, without signal peptide | LQLWDTW ADEAEKALGP LLARDRRQAT EYEYLDYDEL<br>PETEPPEMLR NSTDTTPLTG PGTPESTTVE PAARRSTGLD<br>AGGAVTELTT ELANMGNLST DSAAMEIQTT QPAATEAQTT<br>QPVPTEAQTT PLAATEAQTT RLTATEAQTT PLAATEAQTT<br>PPAATEAQTT QPTGLEAQTT APAAMEAQTT APAAMEAQTT<br>PPAAMEAQTT QTTAMEAQTT APEATEAQTT QPTATEAQTT<br>PLAAMEALST EPSATEALSM EPTTKRGLFI PFSVSSVTHK<br>GIPMAASNLS VNYPVGAPDH ISVKQCLLAI LILALVATIF<br>FVCTVVLAVR LSRKGHMYPV RNYSPTEMVC ISSLLPDGGE<br>GPSATANGGL SKAKSPGLTP EPREDREGDD LTLHSFLP |
| 10 | Human PSGL-1 ECD, with signal peptide | MAVGASGLEG DKMAGAMPLQ LLLLLILLGP GNSLQLWDTW<br>ADEAEKALGP LLARDRRQAT EYEYLDYDFL PETEPPEMLR<br>NSTDTTPLTG PGTPESTTVE PAARRSTGLD AGGAVTELTT<br>ELANMGNLST DSAAMEIQTT QPAATEAQTT QPVPTEAQTT<br>PLAATEAQTT RLTATEAQTT PLAATEAQTT PPAATEAQTT<br>QPTGLEAQTT APAAMEAQTT APAAMEAQTT PPAAMEAQTT QT |
| 11 | P1-069059 VH | EVQLVESGGGLVQPGKSLRLSCAAS**GFTLEDYAMH**WVRQAPGKGLEW<br>VS**GINWNSDHIGYADSVKG**RFTISRDNAKNSLYLQMNSLRTEDTALY<br>YCAK**VPGYSGGWIDAEDD**WGQGTMVTVSS |
| 12 | P1-069059 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 13 | P1-069059 IgG1.3 HC | EVQLVESGGGLVQPGKSLRLSCAASGFTLEDYAMHWVRQAPGKGLEW<br>VSGINWNSDHIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 14 | P1-069059 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 15 | P1-069061 VH | EVQLVESGGGLVQPGKSLRLSCAAS**GFTLEDYAMH**WVRQAPGKGLEW<br>VS**GINWNSAEIGYADSVKG**RFTISRDNAKNSLYLQMNSLRTEDTALY<br>YCAK**VPGYSGGWIDAEDD**WGQGTMVTVSS |

-continued

| SEQ ID NO | Name | Sequence |
|---|---|---|
| 16 | P1-069061 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 17 | P1-069061 IgG1.3 HC | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 18 | P1-069061 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 19 | P1-069063 VH | EVQLVESGGGLVQPGKSLRLSCAAS**GFTLEDYAMH**WVRQAPGKGLEW VS**GINWNSAEIGYADSVKG**RFTISRDNAKNSLYLQMNSLRTEDTALY YCAK**VPGYSGGWIDADDE**WGQGTMVTVSS |
| 20 | P1-069063 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 21 | P1-069063 IgG1.3 HC | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDADDEWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 22 | P1-069063 LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 23 | P1-069065 VH | EVQLVESGGGLVQPGKSLRLSCAAS**GFTLEDEAM**HWVRQAPGKGLEW VS**GINWNSDDIGYADSVKG**RFTISRDNAKNSLYLQMNSLRTEDTALY YCAK**VPGYSGGWIDAFDV**WGQGTMVTVSS |
| 24 | P1-069065 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 25 | P1-069065 IgG1.3 HC | EVQLVESGGGLVQPGKSLRLSCAASGFTLEDEAMHWVRQAPGKGLEW VSGINWNSDDIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 26 | P1-069065 LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 27 | P1-069067 VH | EVQLVESGGGLVQPGKSLRLSCAAS**GFTLDDYAMH**WVRQAPGKGLEW VS**GINWNSEEIGYADSVKG**RFTISRDNAKNSLYLQMNSLRTEDTALY YCAK**VPGYSGGWIDADDE**WGQGTMVTVSS |

-continued

| SEQ ID NO | Name | Sequence |
|---|---|---|
| 28 | P1-069067 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 29 | P1-069067 IgG1.3 HC | EVQLVESGGGLVQPGKSLRLSCAASGFTLDDYAMHWVRQAPGKGLEW<br>VSGINWNSEEIGYADSVKGRFTISRDNAKNSLYLQMNSLRTEDTALY<br>YCAKVPGYSGGWIDADDEWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 30 | P1-069067 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 31 | P1-069069 VH | EVQLVESGGGLVQPGKSLRLSCAAS**GFTLDDYAMH**WVRQAPGKGLEW<br>VS**GINWNSEEIGYADSVKG**RFTISRDNAKNSLYLQMNSLRTEDTALY<br>YCAK**VPGYSGGWIDADDV**WGQGTMVTVSS |
| 32 | P1-069069 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 33 | P1-069069 IgG1.3 HC | EVQLVESGGGLVQPGKSLRLSCAASGFTLDDYAMHWVRQAPGKGLEW<br>VSGINWNSEEIGYADSVKGRFTISRDNAKNSLYLQMNSLRTEDTALY<br>YCAKVPGYSGGWIDADDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 34 | P1-069069 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 35 | P1-069071 VH | EVQLVESGGGLVQPGKSLRLSCAAS**GFTLEDEAMH**WVRQAPGKGLEW<br>VS**GINWNSADIGYADSVKG**RFTISRDNAKNSLYLQMNSLRTEDTALY<br>YCAK**VPGYSEGWIDAFDV**WGQGTMVTVSS |
| 36 | P1-069071 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 37 | P1-069071 IgG1.3 HC | EVQLVESGGGLVQPGKSLRLSCAASGFTLEDEAMHWVRQAPGKGLEW<br>VSGINWNSADIGYADSVKGRFTISRDNAKNSLYLQMNSLRTEDTALY<br>YCAKVPGYSEGWIDAFDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 38 | P1-069071 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 39 | P1-069073 VH | EVQLVESGGGLVQPGKSLRLSCAAS**GFTLEDEAMH**WVRQAPGKGLEW<br>VS**GINWNSAEIGYADSVKG**RFTISRDNAKNSLYLQMNSLRTEDTALY<br>YCAK**VPGYSGGWIDAEDV**WGQGTMVTVSS |

-continued

| SEQ ID NO | Name | Sequence |
|---|---|---|
| 40 | P1-069073 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 41 | P1-069073 IgG1.3 HC | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 42 | P1-069073 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 43 | P1-069075 VH | EVQLVESGGGLVQPGKSLRLSCAAS**GFTLEDYAMH**WVRQAPGKGLEW VS**GINWDSAEIGYADSVKG**RFTISRDNAKNSLYLQMNSLRTEDTALY YCAK**VPGYSHGWIDAEDV**WGQGTMVTVSS |
| 44 | P1-069075 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 45 | P1-069075 IgG1.3 HC | EVQLVESGGGLVQPGKSLRLSCAASGFTLEDYAMHWVRQAPGKGLEW VSGINWDSAEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 46 | P1-069075 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 47 | P1-069077 VH | EVQLVESGGGLVQPGKSLRLSCAAS**GFTLEDEAMH**WVRQAPGKGLEW VS**GINWNSDEIGYADSVKG**RFTISRDNAKNSLYLQMNSLRTEDTALY YCAK**VPGYSGGWIDAFDV**WGQGTMVTVSS |
| 48 | P1-069077 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 49 | P1-069077 IgG1.3 HC | EVQLVESGGGLVQPGKSLRLSCAASGFTLEDEAMHWVRQAPGKGLEW VSGINWNSDEIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 50 | P1-069077 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 51 | P1-068761 VH | EVQLVESGGGLVQPGKSLRLSCAAS**GFTLEDEAMH**WVRQAPGKGLEW VS**GINWNSEEIGYADSVKG**RFTISRDNAKNSLYLQMNSLRTEDTALY YCAK**VPGYSHGWIDAEDV**WGQGTMVTVSS |

-continued

| SEQ ID NO | Name | Sequence |
|---|---|---|
| 52 | P1-068761 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 53 | P1-068761 IgG1.3 HC | EVQLVESGGGLVQPGKSLRLSCAASGFTLEDEAMHWVRQAPGKGLEW<br>VSGINWNSEEIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 54 | P1-068761 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 55 | P1-068767 VH | EVQLVESGGGLVQPGKSLRLSCAAS**GFTLEDYAMH**WVRQAPGKGLEW<br>VS**GIDWNSENIGYADSVKG**RFTISRDNAKNSLYLQMNSLRTEDTALY<br>YCAK**VPGYSGGWIDAEDD**WGQGTMVTVSS |
| 56 | P1-068767 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 57 | P1-068767 IgG1.3 HC | EVQLVESGGGLVQPGKSLRLSCAASGFTLEDYAMHWVRQAPGKGLEW<br>VSGIDWNSENIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 58 | P1-068767 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 59 | P1-068773 VH | EVQLVESGGGLVQPGKSLRLSCAAS**GFTLEDYAMH**WVRQAPGKGLEW<br>VS**GIDWNSDNIGYADSVKG**RFTISRDNAKNSLYLQMNSLRTEDTALY<br>YCAK**VPGYSGGWIDAEDD**WGQGTMVTVSS |
| 60 | P1-068773 VL | EIVLTQSPGTLSLSPGERATLSC**RASQSVSSSYLA**WYQQKPGQAPRL<br>LIY**GASSRAT**GIPDRESGSGSGTDFTLTISRLEPEDFAVYYC**QQYGS**<br>**SPFT**FGPGTKVDIK |
| 61 | P1-068773 IgG1.3 HC | EVQLVESGGGLVQPGKSLRLSCAASGFTLEDYAMHWVRQAPGKGLEW<br>VSGIDWNSDNIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 62 | P1-068773 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 63 | P1-068765 VH | EVQLVESGGGLVQPGKSLRLSCAAS**GFTDEDYAMH**WVRQAPGKGLEW<br>VS**GINWNSEEIGYADSVKG**RFTISRDNAKNSLYLQMNSLRTEDTALY<br>YCAK**VPGYSGGWIDAEDD**WGQGTMVTVSS |

-continued

| SEQ ID NO | Name | Sequence |
|---|---|---|
| 64 | P1-068765 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 65 | P1-068765 IgG1.3 HC | EVQLVESGGGLVQPGKSLRLSCAASGFTDEDYAMHWVRQAPGKGLEW VSGINWNSEEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 66 | P1-068765 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 67 | P1-061029 VH | EVQLVESGGGLVQPGKSLRLSCAAS**GFTLDDYAMH**WVRQAPGKGLEW VS**GINWNSANIGYADSVKG**RFTISRDNAKNSLYLQMNSLRTEDTALY YCAK**VPGYSGGWIDAFDV**WGQGTMVTVSS |
| 68 | P1-061029 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 69 | P1-061029 IgG1.3 HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 70 | P1-061029 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 71 | P1-068757 VH | EVQLVESGGGLVQPGKSLRLSCAAS**GFTLEDEAMH**WVRQAPGKGLEW VS**GINWNSEEIGYADSVKG**RFTISRDNAKNSLYLQMNSLRTEDTALY YCAK**VPGYSGGWIDAEDD**WGQGTMVTVSS |
| 72 | P1-068757 VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 73 | P1-068757 IgG1.3 HC | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 74 | P1-068757 LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 75 | P1-068771 VH | EVQLVESGGGLVQPGKSLRLSCAAS**GFTLEDEAMH**WVRQAPGKGLEW VS**GINWNSHEIGYADSVKG**RFTISRDNAKNSLYLQMNSLRTEDTALY YCAK**VPGYSGGWIDAEDD**WGQGTMVTVSS |

-continued

| SEQ ID NO | Name | Sequence |
|---|---|---|
| 76 | P1-068771 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 77 | P1-068771 IgG1.3 HC | EVQLVESGGGLVQPGKSLRLSCAASGFTLEDEAMHWVRQAPGKGLEW<br>VSGINWNSHEIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 78 | P1-068771 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 79 | P1-068775 VH | EVQLVESGGGLVQPGKSLRLSCAAS**GFTLEDEAMH**WVRQAPGKGLEW<br>VS**GIDWNSEEIGYADSVKG**RFTISRDNAKNSLYLQMNSLRTEDTALY<br>YCAK**VPGYSHGWIDAEDD**WGQGTMVTVSS |
| 80 | P1-068775 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 81 | P1-068775 IgG1.3 HC | EVQLVESGGGLVQPGKSLRLSCAASGFTLEDEAMHWVRQAPGKGLEW<br>VSGIDWNSEEIGYADSVKGRFTISRDNAKNSLYLQMNSLRTEDTALY<br>YCAKVPGYSHGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 82 | P1-068775 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 83 | P1-068769 VH | EVQLVESGGGLVQPGKSLRLSCAAS**GFTLEDEAMH**WVRQAPGKGLEW<br>VS**GINWNSDHIGYADSVKG**RFTISRDNAKNSLYLQMNSLRTEDTALY<br>YCAK**VPGYSGGWIDAEDD**WGQGTMVTVSS |
| 84 | P1-068769 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 85 | P1-068769 IgG1.3 HC | EVQLVESGGGLVQPGKSLRLSCAASGFTLEDEAMHWVRQAPGKGLEW<br>VSGINWNSDHIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 86 | P1-068769 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 87 | P1-068759 VH | EVQLVESGGGLVQPGKSLRLSCAAS**GFTLEDEAMH**WVRQAPGKGLEW<br>VS**GIDWNSENIGYADSVKG**RFTISRDNAKNSLYLQMNSLRTEDTALY<br>YCAK**VPGYSGGWIDAEDD**WGQGTMVTVSS |

-continued

| SEQ ID NO | Name | Sequence |
|---|---|---|
| 88 | P1-068759 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 89 | P1-068759 IgG1.3<br>HC | EVQLVESGGGLVQPGKSLRLSCAASGFTLEDEAMHWVRQAPGKGLEW<br>VSGIDWNSENIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 90 | P1-068759 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 91 | P1-068763 VH | EVQLVESGGGLVQPGKSLRLSCAAS**GFTLEDYAMH**WVRQAPGKGLEW<br>VS**GIDWNSENIGYADSVKG**RFTISRDNAKNSLYLQMNSLRTEDTALY<br>YCAK**VPGYSHGWIDAEDV**WGQGTMVTVSS |
| 92 | P1-068763 VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 93 | P1-068763 IgG1.3<br>HC | EVQLVESGGGLVQPGKSLRLSCAASGFTLEDYAMHWVRQAPGKGLEW<br>VSGIDWNSENIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 94 | P1-068763 LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 95 | P1-061015 VH | QVQLVESGGGVVQPGRSLRLSCAAS**GFTFSSYAMH**WVRQAPGKGLEW<br>VA**IIWYDGSNKYYADSVKG**RFTISRDNSKNTLYLQMNSLRAEDTAVY<br>YCAR**DSGFYSSYYFDY**WGQGTLVTVSS |
| 96 | P1-061015 VL | EIVLTQSPATLSLSPGERATLSC**RASQSVSSSYLA**WYQQKPGQAPRL<br>LIY**DASNRAT**GIPARFSGSGSGTDFTLTISSLEPEDFATYYC**QQYNS**<br>**YPYT**FGQGTKLEIK |
| 97 | P1-061015 IgG1.3<br>HC | QVQLVESGGGVVQPGRSLRLSCAASGFTFSSYAMHWVRQAPGKGLEW<br>VAIIWYDGSNKYYADSVKGRFTISRDNSKNTLYLQMNSLRAEDTAVY<br>YCARDSGFYSSYYFDYWGQGTLVTVSSASTKGPSVFPLAPSSKSTSG<br>GTAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCPA<br>PEAEGAPSVFLFPPKPKDTLMISRTPEVTCVVVDVSHEDPEVKFNWY<br>VDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQ<br>GNVFSCSVMHEALHNHYTQKSLSLSPG |
| 98 | P1-061015 LC | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 99 | P1-068748 VH | QVQLVESGGGVVQPGRSLRLSCAAS**GFTFSHHAMH**WVRQAPGKGLEW<br>VA**IIWYDGSNDDYADSVKG**RFTISRDNSKNTLYLQMNSLRAEDTAVY<br>YCAR**DSGFYDSYYFDY**WGQGTLVTVSS |

-continued

| SEQ ID NO | Name | Sequence |
|---|---|---|
| 100 | P1-068748 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 101 | P1-068748 IgG1.3 HC | QVQLVESGGGVVQPGRSLRLSCAASGFTFSHHAMHWVRQAPGKGLEW VAIIWYDGSNDDYADSVKGRFTISRDNSKNTLYLQMNSLRAEDTAVY YCARDSGFYDSYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 102 | P1-068748 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 103 | P1-068744 VH | QVQLVESGGGVVQPGRSLRLSCAAS**GFTFSEYAMH**WVRQAPGKGLEW VA**HIWYDGSNKYEADSVKG**RFTISRDNSKNTLYLQMNSLRAEDTAVY YCAR**DSGFYESYYFDE**WGQGTLVTVSS |
| 104 | P1-068744 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 105 | P1-068744 IgG1.3 HC | QVQLVESGGGVVQPGRSLRLSCAASGFTFSEYAMHWVRQAPGKGLEW VAHIWYDGSNKYEADSVKGRFTISRDNSKNTLYLQMNSLRAEDTAVY YCARDSGFYESYYFDEWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 106 | P1-068744 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 107 | P1-068736 VH | QVQLVESGGGVVQPGRSLRLSCAAS**GFTFSEYAMH**WVRQAPGKGLEW VA**IDWYDGSNKDYADSVKG**RFTISRDNSKNTLYLQMNSLRAEDTAVY YCAR**DSGFYDSYYFDD**WGQGTLVTVSS |
| 108 | P1-068736 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 109 | P1-068736 IgG1.3 HC | QVQLVESGGGVVQPGRSLRLSCAASGFTFSEYAMHWVRQAPGKGLEW VAIDWYDGSNKDYADSVKGRFTISRDNSKNTLYLQMNSLRAEDTAVY YCARDSGFYDSYYFDDWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 110 | P1-068736 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 111 | P1-068752 VH | QVQLVESGGGVVQPGRSLRLSCAAS**GFTFSSYAMH**WVRQAPGKGLEW VA**EIWYDGSNKDYADSVKG**RFTISRDNSKNTLYLQMNSLRAEDTAVY YCAR**DSGFYDSYYFDE**WGQGTLVTVSS |

-continued

| SEQ ID NO | Name | Sequence |
|---|---|---|
| 112 | P1-068752 VL | EIVLTQSPATLSLSPGERATLSC**RASQSVSSSYLA**WYQQKPGQAPRLLIY**DASNRAT**GIPARFSGSGSGTDFTLTISSLEPEDFATYYC**QQYNSYPYT**FGQGTKLEIK |
| 113 | P1-068752 IgG1.3 HC | QVQLVESGGGVVQPGRSLRLSCAASGFTFSSYAMHWVRQAPGKGLEWVAEIWYDGSNKDYADSVKGRFTISRDNSKNTLYLQMNSLRAEDTAVYYCARDSGFYDSYYFDEWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 114 | P1-068752 LC | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 115 | P1-068740 VH | QVQLVESGGGVVQPGRSLRLSCAAS**GFTFSDYAMH**WVRQAPGKGLEWVA**IIWYDGSDKDYADSVKG**RFTISRDNSKNTLYLQMNSLRAEDTAVYYCAR**DSGFYDSYYFDD**WGQGTLVTVSS |
| 116 | P1-068740 VL | EIVLTQSPATLSLSPGERATLSC**RASQSVSSSYLA**WYQQKPGQAPRLLIY**DASNRAT**GIPARFSGSGSGTDFTLTISSLEPEDFATYYC**QQYNSYPYT**FGQGTKLEIK |
| 117 | P1-068740 IgG1.3 HC | QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYDSYYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 118 | P1-068740 LC | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 119 | P1-068742 VH | QVQLVESGGGVVQPGRSLRLSCAAS**GFTFSDYAMH**WVRQAPGKGLEWVA**IIWYDGSDKDYADSVKG**RFTISRDNSKNTLYLQMNSLRAEDTAVYYCAR**DSGFYEDYYFDY**WGQGTLVTVSS |
| 120 | P1-068742 VL | EIVLTQSPATLSLSPGERATLSC**RASQSVSSSYLA**WYQQKPGQAPRLLIY**DASNRAT**GIPARFSGSGSGTDFTLTISSLEPEDFATYYC**QQYNSYPYT**FGQGTKLEIK |
| 121 | P1-068742 IgG1.3 HC | QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYEDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 122 | P1-068742 LC | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 123 | P1-068746 VH | QVQLVESGGGVVQPGRSLRLSCAAS**GFTFSSYAMH**WVRQAPGKGLEWVA**IIWYDGSNHHYADSVKG**RFTISRDNSKNTLYLQMNSLRAEDTAVYYCAR**DSGFYDSYYFDY**WGQGTLVTVSS |

-continued

| SEQ ID NO | Name | Sequence |
|---|---|---|
| 124 | P1-068746 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 125 | P1-068746 IgG1.3 HC | QVQLVESGGGVVQPGRSLRLSCAASGFTFSSYAMHWVRQAPGKGLEW VAIIWYDGSNHHYADSVKGRFTISRDNSKNTLYLQMNSLRAEDTAVY YCARDSGFYDSYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 126 | P1-068746 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 127 | P1-068750 VH | QVQLVESGGGVVQPGRSLRLSCAAS**GFTFSDYDMH**WVRQAPGKGLEW VA**EIWDDGSNKYYADSVKG**RFTISRDNSKNTLYLQMNSLRAEDTAVY YCAR**DEEFYSSYYFDY**WGQGTLVTVSS |
| 128 | P1-068750 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 129 | P1-068750 IgG1.3 HC | QVQLVESGGGVVQPGRSLRLSCAASGFTFSDYDMHWVRQAPGKGLEW VAEIWDDGSNKYYADSVKGRFTISRDNSKNTLYLQMNSLRAEDTAVY YCARDEEFYSSYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 130 | P1-068750 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 131 | P1-068738 VH | QVQLVESGGGVVQPGRSLRLSCAAS**GFTFSEYAHH**WVRQAPGKGLEW VA**IIWDDGSNHYYADSVKG**RFTISRDNSKNTLYLQMNSLRAEDTAVY YCAR**DSGFYEDYYFDY**WGQGTLVTVSS |
| 132 | P1-068738 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 133 | P1-068738 IgG1.3 HC | QVQLVESGGGVVQPGRSLRLSCAASGFTFSEYAHHWVRQAPGKGLEW VAIIWDDGSNHYYADSVKGRFTISRDNSKNTLYLQMNSLRAEDTAVY YCARDSGFYEDYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 134 | P1-068738 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 135 | P1-068754 VH | QVQLVESGGGVVQPGRSLRLSCAAS**GFTFSDYDMH**WVRQAPGKGLEW VA**EIWDDGSNKYYADSVKG**RFTISRDNSKNTLYLQMNSLRAEDTAVY YCAR**DSGFHSDYYFDY**WGQGTLVTVSS |

-continued

| SEQ ID NO | Name | Sequence |
|---|---|---|
| 136 | P1-068754 VL | EIVLTQSPATLSLSPGERATLSC**RASQSVSSSYLA**WYQQKPGQAPRL LIY**DASNRAT**GIPARFSGSGSGTDFTLTISSLEPEDFATYYC**QQYNS YPYT**FGQGTKLEIK |
| 137 | P1-068754 IgG1.3 HC | QVQLVESGGGVVQPGRSLRLSCAASGFTFSDYDMHWVRQAPGKGLEW VAEIWDDGSNKYYADSVKGRFTISRDNSKNTLYLQMNSLRAEDTAVY YCARDSGFHSDYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 138 | P1-068754 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 139 | P1-069293 VH (P1-068761.IgG1f) | EVQLVESGGGLVQPGKSLRLSCAAS**GFTLEDEAMH**WVRQAPGKGLEW VS**GINWNSEEIGYADSVKG**RFTISRDNAKNSLYLQMNSLRTEDTALY YCAK**VPGYSHGWIDAEDV**WGQGTMVTVSS |
| 140 | P1-069293 VL (P1-068761.IgG1f) | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 141 | P1-069293 HC (P1-068761. IgG1f) | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 142 | P1-069293 LC (P1-068761.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 143 | P1-069298 VH (P1-068767. IgG1f) | EVQLVESGGGLVQPGKSLRLSCAAS**GFTLEDYAMH**WVRQAPGKGLEW VS**GIDWNSENIGYADSVKG**RFTISRDNAKNSLYLQMNSLRTEDTALY YCAK**VPGYSGGWIDAEDD**WGQGTMVTVSS |
| 144 | P1-069298 VL (P1-068767. IgG1f) | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 145 | P1-069298 HC (P1-068767. IgG1f) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 146 | P1-069298 LC (P1-068767. IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 147 | P1-069302 VH (P1-061029.IgG1f) | EVQLVESGGGLVQPGKSLRLSCAAS**GFTLDDYAMH**WVRQAPGKGLEW VS**GINWNSANIGYADSVKG**RFTISRDNAKNSLYLQMNSLRTEDTALY YCAK**VPGYSGGWIDAFDV**WGQGTMVTVSS |

-continued

| SEQ ID NO | Name | Sequence |
|---|---|---|
| 148 | P1-069302 VL (P1-061029.IgG1f) | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 149 | P1-069302 HC (P1-061029.IgG1f) | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 150 | P1-069302 LC (P1-061029.IgG1f) | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 151 | P1-069312 VH (P1-068761.IgG1f afucosylated) | EVQLVESGGGLVQPGKSLRLSCAAS**GFTLEDEAMH**WVRQAPGKGLEW VS**GINWNSEEIGYADSVKG**RFTISRDNAKNSLYLQMNSLRTEDTALY YCAK**VPGYSHGWIDAEDV**WGQGTMVTVSS |
| 152 | P1-069312 VL (P1-068761. IgG1f afucosylated) | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 153 | P1-069312 HC (P1-068761. IgG1f afucosylated) | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 154 | P1-069312 LC (P1-068761.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 155 | P1-069309 VH (P1-068767.IgG1f afucosylated) | EVQLVESGGGLVQPGKSLRLSCAAS**GFTLEDYAMH**WVRQAPGKGLEW VS**GIDWNSENIGYADSVKG**RFTISRDNAKNSLYLQMNSLRTEDTALY YCAK**VPGYSGGWIDAEDD**WGQGTMVTVSS |
| 156 | P1-069309 VL (P1-068767.IgG1f afucosylated) | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 157 | P1-069309 HC (P1-068767.IgG1f afucosylated) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 158 | P1-069309 LC (P1-068767. IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 159 | P1-069307 VH (P1-061029.IgG1f afucosylated) | EVQLVESGGGLVQPGKSLRLSCAAS**GFTLDDYAMH**WVRQAPGKGLEW VS**GINWNSANIGYADSVKG**RFTISRDNAKNSLYLQMNSLRTEDTALY YCAK**VPGYSGGWIDAFDV**WGQGTMVTVSS |

-continued

| SEQ ID NO | Name | Sequence |
|---|---|---|
| 160 | P1-069307 VL (P1-061029.IgG1f afucosylated) | EIVLTQSPGTLSLSPGERATLSC**RASQSVSSSYLA**WYQQKPGQAPRLLIY**GASSRAT**GIPDRESGSGSGTDFTLTISRLEPEDFAVYYC**QQYGSSPFT**FGPGTKVDIK |
| 161 | P1-069307 HC (P1-061029.IgG1f afucosylated) | EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 162 | P1-069307 LC (P1-061029.IgG1f afucosylated) | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 163 | IgG1.3 (or IgG1.3f) heavy chain constant region (L234A, L235E, G237A) | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 164 | Exemplary light chain constant region | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 165 | Human VISTA NP_071436.1 (FIG. 1B) | See FIG. 1B |
| 166 | Cyno VISTA XP 005565644.1 (FIG. 1B) | See FIG. 1B |
| 167 | Mouse VISTA NP_083008.1 (FIG. 1B) | See FIG. 1B |
| 168 | P1-061029 HDR3 chip oligo (FIG. 7A) | **X**PGYSGGWIDAFDV |
| 169 | P1-061029 HDR3 chip oligo (FIG. 7A) | **XX**GYSGGWIDAFDV |
| 170 | P1-061029 HDR3 chip oligo (FIG. 7A) | **X**P**X**YSGGWIDAFDV |
| 171 | P1-061029 HDR3 chip oligo (FIG. 7A) | **X**PG**X**SGGWIDAFDV |
| 172 | P1-061029 HDR3 chip oligo (FIG. 7A) | **X**PGY**X**GGWIDAFDV |
| 173 | P1-061029 HDR3 chip oligo (FIG. 7A) | **X**PGYS**X**GWIDAFDV |
| 174 | P1-061029 HDR3 chip oligo (FIG. 7A) | **X**PGYSG**X**WIDAFDV |
| 175 | P1-061029 HDR3 chip oligo (FIG. 7A) | **X**PGYSGG**X**IDAFDV |

| SEQ ID NO | Name | Sequence |
|---|---|---|
| 176 | P1-061029 HDR3 chip oligo (FIG. 7A) | **X**PGYSGGW**X**DAFDV |
| 177 | P1-061029 HDR3 chip oligo (FIG. 7A) | **X**PGYSGGWI**X**AFDV |
| 178 | P1-061029 HDR3 chip oligo (FIG. 7A) | **X**PGYSGGWID**X**FDV |
| 179 | P1-061029 HDR3 chip oligo (FIG. 7A) | **X**PGYSGGWIDA**X**DV |
| 180 | P1-061029 HDR3 chip oligo (FIG. 7A) | **X**PGYSGGWIDAF**X**V |
| 181 | P1-061029 HDR3 chip oligo (FIG. 7A) | **X**PGYSGGWIDAFD**X** |
| 182 | IgG1f (human wild-type allotype f) heavy chain constant region | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPELLGGPSVFLFPPKPKDTLMISRTPE VTCVVVDVSHEDPEVKFNWYVDGVEVHNAKTKPREEQYNSTYRVVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG |
| 183 | IgG1.1f Heavy chain constant region (L234A, L235E, G237A, A330S, P331S) | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPEAEGAPSVFLFPPKPKDTLMISRTPE VTCVVVDVSHEDPEVKFNWYVDGVEVHNAKTKPREEQYNSTYRVVSV LTVLHQDWLNGKEYKCKVSNKALPSSIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG |
| 184 | IgGlfa. P238K (or IgG1. P238K) heavy chain constant region | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPELLGGKSVFLFPPKPKDTLMISRTPE VTCVVVDVSHEDPEVKENWYVDGVEVHNAKTKPREEQYNSTYRVVSV LTVLHQDWLNGKEYKCKVSNKALPAPIEKTISKAKGQPREPQVYTLP PSRDELTKNQVSLTCLVKGFYPSDIAVEWESNGQPENNYKTTPPVLD SDGSFFLYSKLTVDKSRWQQGNVFSCSVMHEALHNHYTQKSLSLSPG |
| 185 | P1-070864 P1-068761_E30D VH | EVQLVESGGGLVQPGKSLRLSCAAS**GFTLDDEAMH**WVRQAPGKGLEW VS**GINWNSEEIGYADSVKG**RFTISRDNAKNSLYLQMNSLRTEDTALY YCAK**VPGYSHGWIDAEDV**WGQGTMVTVSS |
| 186 | P1-070864 P1-068761_E30D VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 187 | P1-070864 P1-068761_E30D IgG1.3 HC | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 188 | P1-070864 P1-068761_E30D LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |

-continued

| SEQ ID NO | Name | Sequence |
|---|---|---|
| 189 | P1-070866<br>P1-068761_E32Y<br>VH | EVQLVESGGGLVQPGKSLRLSCAAS**GFTLEDYAMH**WVRQAPGKGLEW<br>VS**GINWNSEEIGYADSVKG**RFTISRDNAKNSLYLQMNSLRTEDTALY<br>YCAK**VPGYSHGWIDAEDV**WGQGTMVTVSS |
| 190 | P1-070866<br>P1-068761_E32Y<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 191 | P1-070866<br>P1-068761_E32Y<br>IgG1.3 HC | EVQLVESGGGLVQPGKSLRLSCAASGFTLEDYAMHWVRQAPGKGLEW<br>VSGINWNSEEIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 192 | P1-070866<br>P1-068761_E32Y<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 193 | P1-070868<br>P1-068761_E55A<br>VH | EVQLVESGGGLVQPGKSLRLSCAAS**GFTLEDEAMH**WVRQAPGKGLEW<br>VS**GINWNSAEIGYADSVKG**RFTISRDNAKNSLYLQMNSLRTEDTALY<br>YCAK**VPGYSHGWIDAEDV**WGQGTMVTVSS |
| 194 | P1-070868<br>P1-068761_E55A<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 195 | P1-070868<br>P1-068761_E55A<br>IgG1.3 HC | EVQLVESGGGLVQPGKSLRLSCAASGFTLEDEAMHWVRQAPGKGLEW<br>VSGINWNSAEIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 196 | P1-070868<br>P1-068761_E55A<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 197 | P1-070870<br>P1-068761_E56N<br>VH | EVQLVESGGGLVQPGKSLRLSCAAS**GFTLEDEAMH**WVRQAPGKGLEW<br>VS**GINWNSENIGYADSVKG**RFTISRDNAKNSLYLQMNSLRTEDTALY<br>YCAK**VPGYSHGWIDAEDV**WGQGTMVTVSS |
| 198 | P1-070870<br>P1-068761_E56N<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 199 | P1-070870<br>P1-068761_E56N<br>IgG1.3 HC | EVQLVESGGGLVQPGKSLRLSCAASGFTLEDEAMHWVRQAPGKGLEW<br>VSGINWNSENIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 200 | P1-070870<br>P1-068761_E56N<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |

-continued

| SEQ ID NO | Name | Sequence |
|---|---|---|
| 201 | P1-070872 P1-068761_H100G VH | EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSS |
| 202 | P1-070872 P1-068761_H100G VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK |
| 203 | P1-070872 P1-068761_H100G IgG1.3 HC | EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVELFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 204 | P1-070872 P1-068761_H100G LC | EIVLTQSPGTLSLSPGERATLSCRASQSVSSSYLAWYQQKPGQAPRLLIYGASSRATGIPDRESGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 205 | P1-070874 P1-068761_E100fF VH | EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSS |
| 206 | P1-070874 P1-068761_E100fF VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK |
| 207 | P1-070874 P1-068761_E100fF IgG1.3 HC | EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVELFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 208 | P1-070874 P1-068761_E100fF LC | EIVLTQSPGTLSLSPGERATLSCRASQSVSSSYLAWYQQKPGQAPRLLIYGASSRATGIPDRESGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 209 | P1-070876 P1-068761_E30D_E32Y VH | EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSS |
| 210 | P1-070876 P1-068761_E30D_E32Y VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK |
| 211 | P1-070876 P1-068761_E30D_E32Y IgG1.3 HC | EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 212 | P1-070876 P1-068761_E30D_E32Y LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |

-continued

| SEQ ID NO | Name | Sequence |
|---|---|---|
| 213 | P1-070878 P1-068761_E55A_E56N VH | EVQLVESGGGLVQPGKSLRLSCAAS**GFTLEDEAMH**WVRQAPGKGLEWVS**GINWNSANIGYADSVKG**RFTISRDNAKNSLYLQMNSLRTEDTALYYCAK**VPGYSHGWIDAEDV**WGQGTMVTVSS |
| 214 | P1-070878 P1-068761_E55A_E56N VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 215 | P1-070878 P1-068761_E55A_E56N IgG1.3 HC | EVQLVESGGGLVQPGKSLRLSCAASGFTLEDEAMHWVRQAPGKGLEWVSGINWNSANIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 216 | P1-070878 P1-068761_E55A_E56N LC | EIVLTQSPGTLSLSPGERATLSCRASQSVSSSYLAWYQQKPGQAPRLLIYGASSRATGIPDRESGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 217 | P1-070880 P1-068761_H100G_E100fF VH | EVQLVESGGGLVQPGKSLRLSCAAS**GFTLEDEAMH**WVRQAPGKGLEWVS**GINWNSEEIGYADSVKG**RFTISRDNAKNSLYLQMNSLRTEDTALYYCAK**VPGYSGGWIDAFDV**WGQGTMVTVSS |
| 218 | P1-070880 P1-068761_H100G_E100fF VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 219 | P1-070880 P1-068761_H100G_E100fF IgG1.3 HC | EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVELFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 220 | P1-070880 P1-068761_H100G_E100fF LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 221 | P1-070882 P1-068761_E32Y_E55A VH | EVQLVESGGGLVQPGKSLRLSCAAS**GFTLEDYAMH**WVRQAPGKGLEWVS**GINWNSAEIGYADSVKG**RFTISRDNAKNSLYLQMNSLRTEDTALYYCAK**VPGYSHGWIDAEDV**WGQGTMVTVSS |
| 222 | P1-070882 P1-068761_E32Y_E55A VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYCQQYGS**SPFT**FGPGTKVDIK |
| 223 | P1-070882 P1-068761_E32Y_E55A IgG1.3 HC | EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKV |

-continued

| SEQ ID NO | Name | Sequence |
|---|---|---|
| | | SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 224 | P1-070882<br>P1-<br>068761_E32Y_E55A<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 225 | P1-070884<br>P1-<br>068761_E32Y_E56N<br>VH | EVQLVESGGGLVQPGKSLRLSCAAS**GFTLEDYAMH**WVRQAPGKGLEW<br>VS**GINWNSENIGYADSVKG**RFTISRDNAKNSLYLQMNSLRTEDTALY<br>YCAK**VPGYSHGWIDAEDV**WGQGTMVTVSS |
| 226 | P1-070884<br>P1-<br>068761_E32Y_E56N<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 227 | P1-070884<br>P1-<br>068761_E32Y_E56N<br>IgG1.3 HC | EVQLVESGGGLVQPGKSLRLSCAASGFTLEDYAMHWVRQAPGKGLEW<br>VSGINWNSENIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 228 | P1-070884<br>P1-<br>068761_E32Y_E56N<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 229 | P1-070886<br>P1-<br>068761_E32Y_H100G<br>VH | EVQLVESGGGLVQPGKSLRLSCAAS**GFTLEDYAMH**WVRQAPGKGLEW<br>VS**GINWNSEEIGYADSVKG**RFTISRDNAKNSLYLQMNSLRTEDTALY<br>YCAK**VPGYSGGWIDAEDV**WGQGTMVTVSS |
| 230 | P1-070886<br>P1-<br>068761_E32Y_H100G<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 231 | P1-070886<br>P1-<br>068761_E32Y_H100G<br>IgG1.3 HC | EVQLVESGGGLVQPGKSLRLSCAASGFTLEDYAMHWVRQAPGKGLEW<br>VSGINWNSEEIGYADSVKGRFTISRDNAKNSLYLQMNSLRTEDTALY<br>YCAKVPGYSGGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 232 | P1-070886<br>P1-<br>068761_E32Y_H100G<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 233 | P1-070888<br>P1-<br>068761_E32Y_E100f<br>F<br>VH | EVQLVESGGGLVQPGKSLRLSCAAS**GFTLEDYAMH**WVRQAPGKGLEW<br>VS**GINWNSEEIGYADSVKG**RFTISRDNAKNSLYLQMNSLRTEDTALY<br>YCAK**VPGYSHGWIDAFDV**WGQGTMVTVSS |
| 234 | P1-070888<br>P1-<br>068761_E32Y_E100f<br>F<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |

-continued

| SEQ ID NO | Name | Sequence |
|---|---|---|
| 235 | P1-070888<br>P1-068761_E32Y_E100fF<br>IgG1.3 HC | EVQLVESGGGLVQPGKSLRLSCAASGFTLEDYAMHWVRQAPGKGLEW<br>VSGINWNSEEIGYADSVKGRFTISRDNAKNSLYLQMNSLRTEDTALY<br>YCAKVPGYSHGWIDAFDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 236 | P1-070888<br>P1-068761_E32Y_E100fF<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 237 | P1-070890<br>P1-068761_E30D_E55A<br>VH | EVQLVESGGGLVQPGKSLRLSCAAS**GFTLDDEAMH**WVRQAPGKGLEW<br>VS**GINWNSAEIGYADSVKG**RFTISRDNAKNSLYLQMNSLRTEDTALY<br>YCAK**VPGYSHGWIDAEDV**WGQGTMVTVSS |
| 238 | P1-070890<br>P1-068761_E30D_E55A<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 239 | P1-070890<br>P1-068761_E30D_E55A<br>IgG1.3 HC | EVQLVESGGGLVQPGKSLRLSCAASGFTLDDEAMHWVRQAPGKGLEW<br>VSGINWNSAEIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 240 | P1-070890<br>P1-068761_E30D_E55A<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 241 | P1-070892<br>P1-068761_E30D_E56N<br>VH | EVQLVESGGGLVQPGKSLRLSCAAS**GFTLDDEAMH**WVRQAPGKGLEW<br>VS**GINWNSENIGYADSVKG**RFTISRDNAKNSLYLQMNSLRTEDTALY<br>YCAK**VPGYSHGWIDAEDV**WGQGTMVTVSS |
| 242 | P1-070892<br>P1-068761_E30D_E56N<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 243 | P1-070892<br>P1-068761_E30D_E56N<br>IgG1.3 HC | EVQLVESGGGLVQPGKSLRLSCAASGFTLDDEAMHWVRQAPGKGLEW<br>VSGINWNSENIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 244 | P1-070892<br>P1-068761_E30D_E56N<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 245 | P1-070894<br>P1-068761_E30D_H100G<br>VH | EVQLVESGGGLVQPGKSLRLSCAAS**GFTLDDEAMH**WVRQAPGKGLEW<br>VS**GINWNSEEIGYADSVKG**RFTISRDNAKNSLYLQMNSLRTEDTALY<br>YCAK**VPGYSGGWIDAEDV**WGQGTMVTVSS |

-continued

| SEQ ID NO | Name | Sequence |
|---|---|---|
| 246 | P1-070894 P1-068761_E30D_H100G VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 247 | P1-070894 P1-068761_E30D_H100G IgG1.3 HC | EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVELFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 248 | P1-070894 P1-068761_E30D_H100G LC | EIVLTQSPGTLSLSPGERATLSCRASQSVSSSYLAWYQQKPGQAPRLLIYGASSRATGIPDRESGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 249 | P1-070896 P1-068761_E30D_E100f F VH | EVQLVESGGGLVQPGKSLRLSCAAS**GFTLDDEAMH**WVRQAPGKGLEWVS**GINWNSEEIGYADSVKG**RFTISRDNAKNSLYLQMNSLRTEDTALYYCAK**VPGYSHGWIDAFDV**WGQGTMVTVSS |
| 250 | P1-070896 P1-068761_E30D_E100f F VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 251 | P1-070896 P1-068761_E30D_E100f F IgG1.3 HC | EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 252 | P1-070896 P1-068761_E30D_E100f F LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 253 | P1-070898 P1-068761_E55A_E100f F VH | EVQLVESGGGLVQPGKSLRLSCAAS**GFTLEDEAMH**WVRQAPGKGLEWVS**GINWNSAEIGYADSVKG**RFTISRDNAKNSLYLQMNSLRTEDTALYYCAK**VPGYSHGWIDAFDV**WGQGTMVTVSS |
| 254 | P1-070898 P1-068761_E55A_E100f F VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 255 | P1-070898 P1-068761_E55A_E100f F IgG1.3 HC | EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |

-continued

| SEQ ID NO | Name | Sequence |
|---|---|---|
| 256 | P1-070898<br>P1-068761_E55A_E100fF<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 257 | P1-070900<br>P1-068761_E56N_H100G<br>VH | EVQLVESGGGLVQPGKSLRLSCAAS**GFTLEDEAMH**WVRQAPGKGLEW<br>VS**GINWNSENIGYADSVKG**RFTISRDNAKNSLYLQMNSLRTEDTALY<br>YCAK**VPGYSGGWIDAEDV**WGQGTMVTVSS |
| 258 | P1-070900<br>P1-068761_E56N_H100G<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS<br>SPFT**FGPGTKVDIK |
| 259 | P1-070900<br>P1-068761_E56N_H100G<br>IgG1.3 HC | EVQLVESGGGLVQPGKSLRLSCAASGFTLEDEAMHWVRQAPGKGLEW<br>VSGINWNSENIGYADSVKGRFTISRDNAKNSLYLQMNSLRTEDTALY<br>YCAKVPGYSGGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 260 | P1-070900<br>P1-068761_E56N_H100G<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 261 | P1-070902<br>P1-068761_E56N_E100fF<br>VH | EVQLVESGGGLVQPGKSLRLSCAAS**GFTLEDEAMH**WVRQAPGKGLEW<br>VS**GINWNSENIGYADSVKG**RFTISRDNAKNSLYLQMNSLRTEDTALY<br>YCAK**VPGYSHGWIDAFDV**WGQGTMVTVSS |
| 262 | P1-070902<br>P1-068761_E56N_E100fF<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS<br>SPFT**FGPGTKVDIK |
| 263 | P1-070902<br>P1-068761_E56N_E100fF<br>IgG1.3 HC | EVQLVESGGGLVQPGKSLRLSCAASGFTLEDEAMHWVRQAPGKGLEW<br>VSGINWNSENIGYADSVKGRFTISRDNAKNSLYLQMNSLRTEDTALY<br>YCAKVPGYSHGWIDAFDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 264 | P1-070902<br>P1-068761_E56N_E100fF<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 265 | P1-070904<br>P1-068767_E30D<br>VH | EVQLVESGGGLVQPGKSLRLSCAAS**GFTLDDYAMH**WVRQAPGKGLEW<br>VS**GIDWNSENIGYADSVKG**RFTISRDNAKNSLYLQMNSLRTEDTALY<br>YCAK**VPGYSGGWIDAEDD**WGQGTMVTVSS |
| 266 | P1-070904<br>P1-068767_E30D<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS<br>SPFT**FGPGTKVDIK |
| 267 | P1-070904<br>P1-068767_E30D<br>IgG1.3 HC | EVQLVESGGGLVQPGKSLRLSCAASGFTLDDYAMHWVRQAPGKGLEW<br>VSGIDWNSENIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN |

-continued

| SEQ ID NO | Name | Sequence |
|---|---|---|
| | | WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 268 | P1-070904<br>P1-068767_E30D<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 269 | P1-070906<br>P1-068767_D52N<br>VH | EVQLVESGGGLVQPGKSLRLSCAAS**GFTLEDYAMH**WVRQAPGKGLEW<br>VS**GINWNSENIGYADSVKG**RFTISRDNAKNSLYLQMNSLRTEDTALY<br>YCAK**VPGYSGGWIDAEDD**WGQGTMVTVSS |
| 270 | P1-070906<br>P1-068767_D52N<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 271 | P1-070906<br>P1-068767_D52N<br>IgG1.3 HC | EVQLVESGGGLVQPGKSLRLSCAASGFTLEDYAMHWVRQAPGKGLEW<br>VSGINWNSENIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 272 | P1-070906<br>P1-068767_D52N<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 273 | P1-070908<br>P1-068767_E55A<br>VH | EVQLVESGGGLVQPGKSLRLSCAAS**GFTLEDYAMH**WVRQAPGKGLEW<br>VSGIDWNSANIGYADSVKGRFTISRDNAKNSLYLQMNSLRTEDTALY<br>YCAK**VPGYSGGWIDAEDD**WGQGTMVTVSS |
| 274 | P1-070908<br>P1-068767_E55A<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 275 | P1-070908<br>P1-068767_E55A<br>IgG1.3 HC | EVQLVESGGGLVQPGKSLRLSCAASGFTLEDYAMHWVRQAPGKGLEW<br>VSGIDWNSANIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 276 | P1-070908<br>P1-068767_E55A<br>LC | EIVLTQSPGTLSLSPGERATLSCRASQSVSSSYLAWYQQKPGQAPRL<br>LIYGASSRATGIPDRESGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 277 | P1-070910<br>P1-068767_E100fF<br>VH | EVQLVESGGGLVQPGKSLRLSCAAS**GFTLEDYAMH**WVRQAPGKGLEW<br>VS**GIDWNSENIGYADSVKG**RFTISRDNAKNSLYLQMNSLRTEDTALY<br>YCAKVPGYSGGWIDAFDDWGQGTMVTVSS |
| 278 | P1-070910<br>P1-068767_E100fF<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 279 | P1-070910<br>P1-068767_E100fF<br>IgG1.3 HC | EVQLVESGGGLVQPGKSLRLSCAASGFTLEDYAMHWVRQAPGKGLEW<br>VSGIDWNSENIGYADSVKGRFTISRDNAKNSLYLQMNSLRTEDTALY<br>YCAKVPGYSGGWIDAFDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKEN |

-continued

| SEQ ID NO | Name | Sequence |
|---|---|---|
| | | WYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 280 | P1-070910<br>P1-068767_E100fF<br>LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 281 | P1-070912<br>P1-068767_D102V<br>VH | EVQLVESGGGLVQPGKSLRLSCAAS**GFTLEDYAMH**WVRQAPGKGLEWVS**GIDWNSENIGYADSVKG**RFTISRDNAKNSLYLQMNSLRTEDTALYYCAK**VPGYSGGWIDAEDV**WGQGTMVTVSS |
| 282 | P1-070912<br>P1-068767_D102V<br>VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 283 | P1-070912<br>P1-068767_D102V<br>IgG1.3 HC | EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVELFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 284 | P1-070912<br>P1-068767_D102V<br>LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 285 | P1-070914<br>P1-<br>068767_E30D_D52N<br>VH | EVQLVESGGGLVQPGKSLRLSCAAS**GFTLDDYAMH**WVRQAPGKGLEWVS**GINWNSENIGYADSVKG**RFTISRDNAKNSLYLQMNSLRTEDTALYYCAK**VPGYSGGWIDAEDD**WGQGTMVTVSS |
| 286 | P1-070914<br>P1-<br>068767_E30D_D52N<br>VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 287 | P1-070914<br>P1-<br>068767_E30D_D52N<br>IgG1.3 HC | EVQLVESGGGLVQPGKSLRLSCAASGFTLDDYAMHWVRQAPGKGLEWVSGINWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 288 | P1-070914<br>P1-<br>068767_E30D_D52N<br>LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 289 | P1-070916<br>P1-<br>068767_D52N_E55A<br>VH | EVQLVESGGGLVQPGKSLRLSCAAS**GFTLEDYAMH**WVRQAPGKGLEWVS**GINWNSANIGYADSVKG**RFTISRDNAKNSLYLQMNSLRTEDTALYYCAK**VPGYSGGWIDAEDD**WGQGTMVTVSS |
| 290 | P1-070916<br>P1-<br>068767_D52N_E55A<br>VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |

-continued

| SEQ ID NO | Name | Sequence |
|---|---|---|
| 291 | P1-070916 P1-068767_D52N_E55A IgG1.3 HC | EVQLVESGGGLVQPGKSLRLSCAASGFTLEDYAMHWVRQAPGKGLEW VSGINWNSANIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 292 | P1-070916 P1-068767_D52N_E55A LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 293 | P1-070918 P1-068767_E55A_E100fF VH | EVQLVESGGGLVQPGKSLRLSCAAS**GFTLEDYAMH**WVRQAPGKGLEW VS**GIDWNSANIGYADSVKG**RFTISRDNAKNSLYLQMNSLRTEDTALY YCAK**VPGYSGGWIDAFDD**WGQGTMVTVSS |
| 294 | P1-070918 P1-068767_E55A_E100fF VL | EIVLTQSPGTLSLSPGERATLSC**RASQSVSSSYLA**WYQQKPGQAPRL LIY**GASSRAT**GIPDRFSGSGSGTDFTLTISRLEPEDFAVYYC**QQYGS SPFT**FGPGTKVDIK |
| 295 | P1-070918 P1-068767_E55A_E100fF IgG1.3 HC | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 296 | P1-070918 P1-068767_E55A_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 297 | P1-070920 P1-068767_E100fF_D102V VH | EVQLVESGGGLVQPGKSLRLSCAAS**GFTLEDYAMH**WVRQAPGKGLEW VS**GIDWNSENIGYADSVKG**RFTISRDNAKNSLYLQMNSLRTEDTALY YCAK**VPGYSGGWIDAFDV**WGQGTMVTVSS |
| 298 | P1-070920 P1-068767_E100fF_D102V VL | EIVLTQSPGTLSLSPGERATLSC**RASQSVSSSYLA**WYQQKPGQAPRL LIY**GASSRAT**GIPDRESGSGSGTDFTLTISRLEPEDFAVYYC**QQYGS SPFT**FGPGTKVDIK |
| 299 | P1-070920 P1-068767_E100fF_D102V IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 300 | P1-070920 P1-068767_E100fF_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |

-continued

| SEQ ID NO | Name | Sequence |
|---|---|---|
| 301 | P1-070922 P1-068767_E30D_E55A VH | EVQLVESGGGLVQPGKSLRLSCAAS**GFTLDDYAMH**WVRQAPGKGLEWVS**GIDWNSANIGYADSVKG**RFTISRDNAKNSLYLQMNSLRTEDTALYYCAK**VPGYSGGWIDAEDD**WGQGTMVTVSS |
| 302 | P1-070922 P1-068767_E30D_E55A VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 303 | P1-070922 P1-068767_E30D_E55A IgG1.3 HC | EVQLVESGGGLVQPGKSLRLSCAASGFTLDDYAMHWVRQAPGKGLEWVSGIDWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 304 | P1-070922 P1-068767_E30D_E55A LC | EIVLTQSPGTLSLSPGERATLSCRASQSVSSSYLAWYQQKPGQAPRLLIYGASSRATGIPDRESGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 305 | P1-070924 P1-068767_E30D_E100fF VH | EVQLVESGGGLVQPGKSLRLSCAAS**GFTLDDYAMH**WVRQAPGKGLEWVS**GIDWNSENIGYADSVKG**RFTISRDNAKNSLYLQMNSLRTEDTALYYCAK**VPGYSGGWIDAFDD**WGQGTMVTVSS |
| 306 | P1-070924 P1-068767_E30D_E100fF VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 307 | P1-070924 P1-068767_E30D_E100fF IgG1.3 HC | EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 308 | P1-070924 P1-068767_E30D_E100fF LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSENRGEC |
| 309 | P1-070926 P1-068767_E30D_D102V VH | EVQLVESGGGLVQPGKSLRLSCAAS**GFTLDDYAMH**WVRQAPGKGLEWVS**GIDWNSENIGYADSVKG**RFTISRDNAKNSLYLQMNSLRTEDTALYYCAK**VPGYSGGWIDAEDV**WGQGTMVTVSS |
| 310 | P1-070926 P1-068767_E30D_D102V VL | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPFT**FGPGTKVDIK |
| 311 | P1-070926 P1-068767_E30D_D102V IgG1.3 HC | EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKENWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |

-continued

| SEQ ID NO | Name | Sequence |
|---|---|---|
| 312 | P1-070926<br>P1-<br>068767_E30D_D102V<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 313 | P1-070928<br>P1-<br>068767_D52N_E100f<br>F<br>VH | EVQLVESGGGLVQPGKSLRLSCAAS**GFTLEDYAMH**WVRQAPGKGLEW<br>VS**GINWNSENIGYADSVKG**RFTISRDNAKNSLYLQMNSLRTEDTALY<br>YCAK**VPGYSGGWIDAFDD**WGQGTMVTVSS |
| 314 | P1-070928<br>P1-<br>068767_D52N_E100f<br>F<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 315 | P1-070928<br>P1-<br>068767_D52N_E100f<br>F<br>IgG1.3 HC | EVQLVESGGGLVQPGKSLRLSCAASGFTLEDYAMHWVRQAPGKGLEW<br>VSGINWNSENIGYADSVKGRFTISRDNAKNSLYLQMNSLRTEDTALY<br>YCAKVPGYSGGWIDAFDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 316 | P1-070928<br>P1-<br>068767_D52N_E100f<br>F<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 317 | P1-070930<br>P1-<br>068767_D52N_D102V<br>VH | EVQLVESGGGLVQPGKSLRLSCAAS**GFTLEDYAMH**WVRQAPGKGLEW<br>VS**GINWNSENIGYADSVKG**RFTISRDNAKNSLYLQMNSLRTEDTALY<br>YCAK**VPGYSGGWIDAEDV**WGQGTMVTVSS |
| 318 | P1-070930<br>P1-<br>068767_D52N_D102V<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 319 | P1-070930<br>P1-<br>068767_D52N_D102V<br>IgG1.3 HC | EVQLVESGGGLVQPGKSLRLSCAASGFTLEDYAMHWVRQAPGKGLEW<br>VSGINWNSENIGYADSVKGRFTISRDNAKNSLYLQMNSLRTEDTALY<br>YCAKVPGYSGGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVELFPPKPKDTLMISRTPEVTCVVVDVSHEDPEVKEN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 320 | P1-070930<br>P1-<br>068767_D52N_D102V<br>LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSENRGEC |
| 321 | P1-070932<br>P1-<br>068767_E55A_D102V<br>VH | EVQLVESGGGLVQPGKSLRLSCAAS**GFTLEDYAMH**WVRQAPGKGLEW<br>VS**GIDWNSANIGYADSVKG**RFTISRDNAKNSLYLQMNSLRTEDTALY<br>YCAK**VPGYSGGWIDAEDV**WGQGTMVTVSS |
| 322 | P1-070932<br>P1-<br>068767_E55A_D102V<br>VL | EIVLTQSPGTLSLSPGERATLSC**RASQSVSSSYLA**WYQQKPGQAPRL<br>LIY**GASSRAT**GIPDRFSGSGSGTDFTLTISRLEPEDFAVYYC**QQYGS**<br>**SPFT**FGPGTKVDIK |
| 323 | P1-070932<br>P1-<br>068767_E55A_D102V<br>IgG1.3 HC | EVQLVESGGGLVQPGKSLRLSCAASGFTLEDYAMHWVRQAPGKGLEW<br>VSGIDWNSANIGYADSVKGRFTISRDNAKNSLYLQMNSLRTEDTALY<br>YCAKVPGYSGGWIDAEDVWGQGTMVTVSSASTKGPSVFPLAPSSKST<br>SGGTAALGCLVKDYFPEPVTVSWNSGALTSGVHTFPAVLQSSGLYSL |

-continued

| SEQ ID NO | Name | Sequence |
|---|---|---|
| | | SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 324 | P1-070932 P1-068767_E55A_D102V LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 325 | hVISTA-ECD 6-His tag | AFKVATPYSL YVCPEGQNVT LTCRLLGPVD KGHDVTFYKT WYRSSRGEVQ TCSERRPIRN LTFQDLHLHH GGHQAANTSH DLAQRHGLES ASDHHGNFSI TMRNLTLLDS GLYCCLVVEI RHHHSEHRVH GAMELQVQTG KDAPSNCVVY PSSSQESENI TAHHHHHH |
| 326 | Cyno VISTA-ECD 6-His tag | AFKVATLYSL YVCPEGQNVT LTCRVFGPVD KGHDVTFYKT WYRSSRGEVQ TCSERRPIRN LTFQDLHLHH GGHQAANTSH DLAQRHGLES ASDHHGNFSI TMRNLTLLDS GLYCCLVVEI RHHHSEHRVH GAMELQVQTG KDAPSSCVAY PSSSQESENI TAHHHHHH |
| 327 | P1-069059 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGACCATATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 328 | P1-069059 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 329 | P1-069061 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 330 | P1-069061 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 331 | P1-069063 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGAATGGGGCCAAGGGACAATGGTCACCGTCTCTTCA |
| 332 | P1-069063 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |

-continued

| SEQ ID NO | Name | Sequence |
|---|---|---|
| 333 | P1-069065 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGACGACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 334 | P1-069065 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 335 | P1-069067 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGAATGGGGCCAAGGGACAATGGTCACCGTCTCTTCA |
| 336 | P1-069067 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 337 | P1-069069 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGTCTGGGGCCAAGGGACAATGGTCACCGTCTCTTCA |
| 338 | P1-069069 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 339 | P1-069071 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGCTGACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGAAGGCTGGATTGACGCTTT TGATGTCTGGGGCCAAGGGACAATGGTCACCGTCTCTTCA |
| 340 | P1-069071 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 341 | P1-069073 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |

-continued

| SEQ ID NO | Name | Sequence |
|---|---|---|
| 342 | P1-069073 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 343 | P1-069075 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGGACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 344 | P1-069075 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 345 | P1-069077 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGACGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 346 | P1-069077 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 347 | P1-068761 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 348 | P1-068761 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 349 | P1-068767 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 350 | P1-068767 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |

-continued

| SEQ ID NO | Name | Sequence |
|---|---|---|
| 351 | P1-068773 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGATAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 352 | P1-068773 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 353 | P1-068765 VH DNA | GAGGTGCAGCTGGTGGAGTCTGGGGGAGGCTTGGTACAGCCTGGCAA GTCCCTGAGACTCTCCTGTGCAGCCTCTGGATTCACCGATGAGGATT ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 354 | P1-068765 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 355 | P1-061029 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 356 | P1-061029 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 357 | P1-068757 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 358 | P1-068757 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 359 | P1-068771 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTCATGAGATAGGCTATGCGGACTC TGTGAAGGGCCGATTCACCATCTCCAGAGACAACGCCAAGAACTCCC |

-continued

| SEQ ID NO | Name | Sequence |
|---|---|---|
| | | TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 360 | P1-068771 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 361 | P1-068775 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTGATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGACTGGGGCCAAGGGACAATGGTCACCGTCTCTTCA |
| 362 | P1-068775 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 363 | P1-068769 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGATCACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 364 | P1-068769 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 365 | P1-068759 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 366 | P1-068759 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 367 | P1-068763 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 368 | P1-068763 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT |

-continued

| SEQ ID NO | Name | Sequence |
|---|---|---|
| | | CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 369 | P1-061015 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCAATTATATGGTATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACTA CTGGGGCCAGGGAACCCTGGTCACCGTCTCCTCA |
| 370 | P1-061015 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 371 | P1-068748 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACC ATGCCATGCACTGGGTCCGCCAGGCTCCAGGCAAGGGGCTGGAGTGG GTGGCAATTATATGGTATGATGGAAGTAATGACGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 372 | P1-068748 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 373 | P1-068744 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCATGCACTGGGTCCGCCAGGCTCCAGGCAAGGGGCTGGAGTGG GTGGCACATATATGGTATGATGGAAGTAATAAATACGAGGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAATCGTACTACTTTGACGA GTGGGGCCAGGGAACCCTGGTCACCGTCTCCTCA |
| 374 | P1-068744 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 375 | P1-068736 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCATGCACTGGGTCCGCCAGGCTCCAGGCAAGGGGCTGGAGTGG GTGGCAATTGATTGGTATGATGGAAGTAATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACGA CTGGGGCCAGGGAACCCTGGTCACCGTCTCCTCA |
| 376 | P1-068736 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 377 | P1-068752 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCAGAGATATGGTATGATGGAAGTAATAAAGACTATGCAGACTC |

-continued

| SEQ ID NO | Name | Sequence |
|---|---|---|
| | | CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACGA GTGGGGCCAGGGAACCCTGGTCACCGTCTCCTCA |
| 378 | P1-068752 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 379 | P1-068740 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGACT ATGCCATGCACTGGGTCCGCCAGGCTCCAGGCAAGGGGCTGGAGTGG GTGGCAATTATATGGTATGATGGAAGTGATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACGA CTGGGGCCAGGGAACCCTGGTCACCGTCTCCTCA |
| 380 | P1-068740 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 381 | P1-068742 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGACT ATGCCATGCACTGGGTCCGCCAGGCTCCAGGCAAGGGGCTGGAGTGG GTGGCAATTATATGGTATGATGGAAGTGATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAAGATTACTACTTTGACTA CTGGGGCCAGGGAACCCTGGTCACCGTCTCCTCA |
| 382 | P1-068742 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 383 | P1-068746 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCAATTATATGGTATGATGGAAGTAATCACCACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 384 | P1-068746 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 385 | P1-068750 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGACT ATGACATGCACTGGGTCCGCCAGGCTCCAGGCAAGGGGCTGGAGTGG GTGGCAGAGATATGGGATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATGAGGAATTTTACTCCTCGTACTACTTTGACTA CTGGGGCCAGGGAACCCTGGTCACCGTCTCCTCA |
| 386 | P1-068750 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC |

-continued

| SEQ ID NO | Name | Sequence |
|---|---|---|
| | | CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 387 | P1-068738 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCCATCACTGGGTCCGCCAGGCTCCAGGCAAGGGGCTGGAGTGG GTGGCAATTATATGGGATGATGGAAGTAATCACTACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAAGATTACTACTTTGACTA CTGGGGCCAGGGAACCCTGGTCACCGTCTCCTCA |
| 388 | P1-068738 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 389 | P1-068754 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGACT ATGACATGCACTGGGTCCGCCAGGCTCCAGGCAAGGGGCTGGAGTGG GTGGCAGAGATATGGGATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTCACTCCGATTACTACTTTGACTA CTGGGGCCAGGGAACCCTGGTCACCGTCTCCTCA |
| 390 | P1-068754 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 391 | P1-070864 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 392 | P1-070864 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 393 | P1-070866 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 394 | P1-070866 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 395 | P1-070868 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG |

-continued

| SEQ ID NO | Name | Sequence |
|---|---|---|
| | | GTCTCAGGTATTAATTGGAACAGTGCTGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 396 | P1-070868 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 397 | P1-070870 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 398 | P1-070870 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 399 | P1-070872 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |
| 400 | P1-070872 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 401 | P1-070874 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTTT TGATGTCTGGGGCCAAGGGACAATGGTCACCGTCTCTTCA |
| 402 | P1-070874 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 403 | P1-070876 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 404 | P1-070876 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA |

-continued

| SEQ ID NO | Name | Sequence |
|---|---|---|
| | | GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 405 | P1-070878 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 406 | P1-070878 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 407 | P1-070880 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 408 | P1-070880 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 409 | P1-070882 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGCTGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 410 | P1-070882 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 411 | P1-070884 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 412 | P1-070884 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 413 | P1-070886 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT |

-continued

| SEQ ID NO | Name | Sequence |
|---|---|---|
| | | ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |
| 414 | P1-070886 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 415 | P1-070888 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTTT TGATGTCTGGGGCCAAGGGACAATGGTCACCGTCTCTTCA |
| 416 | P1-070888 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 417 | P1-070890 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 418 | P1-070890 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 419 | P1-070892 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 420 | P1-070892 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 421 | P1-070894 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |

-continued

| SEQ ID NO | Name | Sequence |
|---|---|---|
| 422 | P1-070894 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 423 | P1-070896 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTTT TGATGTCTGGGGCCAAGGGACAATGGTCACCGTCTCTTCA |
| 424 | P1-070896 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 425 | P1-070898 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGCTGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTTT TGATGTCTGGGGCCAAGGGACAATGGTCACCGTCTCTTCA |
| 426 | P1-070898 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 427 | P1-070900 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |
| 428 | P1-070900 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 429 | P1-070902 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTTT TGATGTCTGGGGCCAAGGGACAATGGTCACCGTCTCTTCA |
| 430 | P1-070902 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |

-continued

| SEQ ID NO | Name | Sequence |
|---|---|---|
| 431 | P1-070904 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 432 | P1-070904 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 433 | P1-070906 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 434 | P1-070906 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 435 | P1-070908 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 436 | P1-070908 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 437 | P1-070910 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 438 | P1-070910 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 439 | P1-070912 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |

-continued

| SEQ ID NO | Name | Sequence |
|---|---|---|
| 440 | P1-070912 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 441 | P1-070914 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 442 | P1-070914 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 443 | P1-070916 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 444 | P1-070916 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 445 | P1-070918 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGACTGGGGCCAAGGGACAATGGTCACCGTCTCTTCA |
| 446 | P1-070918 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 447 | P1-070920 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 448 | P1-070920 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |

-continued

| SEQ ID NO | Name | Sequence |
|---|---|---|
| 449 | P1-070922 VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTGATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAAGATGACTGGGGCCAAGGGACAATGGTCACCGTCTCTTCA |
| 450 | P1-070922 VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 451 | P1-070924 VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTGATTGGAACAGTGAAAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTTTTGATGACTGGGGCCAAGGGACAATGGTCACCGTCTCTTCA |
| 452 | P1-070924 VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 453 | P1-070926 VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTGATTGGAACAGTGAAAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAAGATGTCTGGGGCCAAGGGACAATGGTCACCGTCTCTTCA |
| 454 | P1-070926 VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 455 | P1-070928 VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGAGGATTATGCCATGCACTGGGTCCGGCAAGCTCCAGGGAAGGGCCTGGAGTGGGTCTCAGGTATTAATTGGAACAGTGAAAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTTTTGATGACTGGGGCCAAGGGACAATGGTCACCGTCTCTTCA |
| 456 | P1-070928 VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 457 | P1-070930 VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGAGGATTATGCCATGCACTGGGTCCGGCAAGCTCCAGGGAAGGGCCTGGAGTGGGTCTCAGGTATTAATTGGAACAGTGAAAACATAGGCTATGCGGACTC |

-continued

| SEQ ID NO | Name | Sequence |
|---|---|---|
| | | TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 458 | P1-070930 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 459 | P1-070932 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 460 | P1-070932 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 461 | IgG1. 3 heavy chain constant region DNA | GCGTCGACCAAGGGCCCATCGGTCTTCCCCCTGGCACCCTCCTCCAA<br>GAGCACCTCTGGGGGCACAGCGGCCCTGGGCTGCCTGGTCAAGGACT<br>ACTTCCCCGAACCGGTGACGGTGTCGTGGAACTCAGGCGCCCTGACC<br>AGCGGCGTGCACACCTTCCCGGCTGTCCTACAGTCCTCAGGACTCTA<br>CTCCCTCAGCAGCGTGGTGACCGTGCCCTCCAGCAGCTTGGGCACCC<br>AGACCTACATCTGCAACGTGAATCACAAGCCCAGCAACACCAAGGTG<br>GACAAGAGAGTTGAGCCCAAATCTTGTGACAAAACTCACACATGCCC<br>ACCGTGCCCAGCACCTGAAGCCGAAGGGGCCCCGTCAGTCTTCCTCT<br>TCCCCCCAAAACCCAAGGACACCCTCATGATCTCCCGGACCCCTGAG<br>GTCACATGCGTGGTGGTGGACGTGAGCCACGAAGACCCTGAGGTCAA<br>GTTCAACTGGTACGTGGACGGCGTGGAGGTGCATAATGCCAAGACAA<br>AGCCGCGGGAGGAGCAGTACAACAGCACGTACCGTGTGGTCAGCGTC<br>CTCACCGTCCTGCACCAGGACTGGCTGAATGGCAAGGAGTACAAGTG<br>CAAGGTCTCCAACAAAGCCCTCCCAGCCCCCATCGAGAAAACCATCT<br>CCAAAGCCAAAGGGCAGCCCCGAGAACCACAGGTGTACACCCTGCCC<br>CCATCCCGGGAGGAGATGACCAAGAACCAGGTCAGCCTGACCTGCCT<br>GGTCAAAGGCTTCTATCCCAGCGACATCGCCGTGGAGTGGGAGAGCA<br>ATGGGCAGCCGGAGAACAACTACAAGACCACGCCTCCCGTGCTGGAC<br>TCCGACGGCTCCTTCTTCCTCTATAGCAAGCTCACCGTGGCGTCGAC<br>CAAGGGCCCATCGGTCTTCCCCCTGGCACCCTCCTCCAAGAGCACCT<br>CTGGGGGCACAGCGGCCCTGGGCTGCCTGGTCAAGGACTACTTCCCC<br>GAACCGGTGACGGTGTCGTGGAACTCAGGCGCCCTGACCAGCGGCGT<br>GCACACCTTCCCGGCTGTCCTACAGTCCTCAGGACTCTACTCCCTCA<br>GCAGCGTGGTGACCGTGCCCTCCAGCAGCTTGGGCACCCAGACCTAC<br>ATCTGCAACGTGAATCACAAGCCCAGCAACACCAAGGTGGACAAGAG<br>AGTTGAGCCCAAATCTTGTGACAAAACTCACACATGCCCACCGTGCC<br>CAGCACCTGAAGCCGAAGGGGCCCCGTCAGTCTTCCTCTTCCCCCCA<br>AAACCCAAGGACACCCTCATGATCTCCCGGACCCCTGAGGTCACATG<br>CGTGGTGGTGGACGTGAGCCACGAAGACCCTGAGGTCAAGTTCAACT<br>GGTACGTGGACGGCGTGGAGGTGCATAATGCCAAGACAAAGCCGCGG<br>GAGGAGCAGTACAACAGCACGTACCGTGTGGTCAGCGTCCTCACCGT<br>CCTGCACCAGGACTGGCTGAATGGCAAGGAGTACAAGTGCAAGGTCT<br>CCAACAAAGCCCTCCCAGCCCCCATCGAGAAAACCATCTCCAAAGCC<br>AAAGGGCAGCCCCGAGAACCACAGGTGTACACCCTGCCCCCATCCCG<br>GGAGGAGATGACCAAGAACCAGGTCAGCCTGACCTGCCTGGTCAAAG<br>GCTTCTATCCCAGCGACATCGCCGTGGAGTGGGAGAGCAATGGGCAG<br>CCGGAGAACAACTACAAGACCACGCCTCCCGTGCTGGACTCCGACGG<br>CTCCTTCTTCCTCTATAGCAAGCTCACCGTGGACAAGAGCAGGTGGC<br>AGCAGGGGAACGTCTTCTCATGCTCCGTGATGCATGAGGCTCTGCAC<br>AACCACTACACGCAGAAGAGCCTCTCCCTGTCCCCGGGTTGA |
| 462 | Exemplary light chain constant region DNA | CGTACGGTGGCTGCACCATCTGTCTTCATCTTCCCGCCATCTGATGA<br>GCAGTTGAAATCTGGAACTGCCTCTGTTGTGTGCCTGCTGAATAACT<br>TCTATCCCAGAGAGGCCAAAGTACAGTGGAAGGTGGATAACGCCCTC<br>CAATCGGGTAACTCCCAGGAGAGTGTCACAGAGCAGGACAGCAAGGA |

-continued

| SEQ ID NO | Name | Sequence |
|---|---|---|
| | | CAGCACCTACAGCCTCAGCAGCACCCTGACGCTGAGCAAAGCAGACT ACGAGAAACACAAAGTCTACGCCTGCGAAGTCACCCATCAGGGCCTG AGCTCGCCCGTCACAAAGAGCTTCAACAGGGGAGAGTGTTAG |
| 463 | P1-068761 VH K16R T84A | EVQLVESGGGLVQPGRSLRLSCAASGFTLEDEAMHWVRQAPGKGLEW VSGINWNSEEIGYADSVKGRFTISRDNAKNSLYLQMNSLRAEDTALY YCAKVPGYSHGWIDAEDVWGQGTMVTVSS |
| 464 | P1-068761 VH K16R | EVQLVESGGGLVQPGRSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 465 | P1-068761 VH T84A | EVQLVESGGGLVQPGKSLRLSCAASGFTLEDEAMHWVRQAPGKGLEW VSGINWNSEEIGYADSVKGRFTISRDNAKNSLYLQMNSLRAEDTALY YCAKVPGYSHGWIDAEDVWGQGTMVTVSS |
| 466 | P1-068761 K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 467 | P1-061029 VH K16R T84A | EVQLVESGGGLVQPGRSLRLSCAASGFTLDDYAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 468 | P1-061029 VH K16R | EVQLVESGGGLVQPGRSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 469 | P1-061029 VH T84A | EVQLVESGGGLVQPGKSLRLSCAASGFTLDDYAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 470 | P1-061029 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 471 | P1-068767 VH K16R T84A | EVQLVESGGGLVQPGRSLRLSCAASGFTLEDYAMHWVRQAPGKGLEW VSGIDWNSENIGYADSVKGRFTISRDNAKNSLYLQMNSLRAEDTALY YCAKVPGYSGGWIDAEDDWGQGTMVTVSS |
| 472 | P1-068767 VH K16R | EVQLVESGGGLVQPGRSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 473 | P1-068767 VH T84A | EVQLVESGGGLVQPGKSLRLSCAASGFTLEDYAMHWVRQAPGKGLEW VSGIDWNSENIGYADSVKGRFTISRDNAKNSLYLQMNSLRAEDTALY YCAKVPGYSGGWIDAEDDWGQGTMVTVSS |
| 474 | P1-068767 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 475 | P1-070868 (P1-068761_E55A) VH K16R T84A | EVQLVESGGGLVQPGRSLRLSCAASGFTLEDEAMHWVRQAPGKGLEW VSGINWNSAEIGYADSVKGRFTISRDNAKNSLYLQMNSLRAEDTALY YCAKVPGYSHGWIDAEDVWGQGTMVTVSS |
| 476 | P1-070868 VH K16R | EVQLVESGGGLVQPGRSLRLSCAASGFTLEDEAMHWVRQAPGKGLEW VSGINWNSAEIGYADSVKGRFTISRDNAKNSLYLQMNSLRTEDTALY YCAKVPGYSHGWIDAEDVWGQGTMVTVSS |

-continued

| SEQ ID NO | Name | Sequence |
|---|---|---|
| 477 | P1-070868 VH T84A | EVQLVESGGGLVQPGKSLRLSCAASGFTLEDEAMHWVRQAPGKGLEW VSGINWNSAEIGYADSVKGRFTISRDNAKNSLYLQMNSLRAEDTALY YCAKVPGYSHGWIDAEDVWGQGTMVTVSS |
| 478 | P1-070868 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 479 | P1-70906 (P1-068767_D52N) VH K16R T84A | EVQLVESGGGLVQPGRSLRLSCAASGFTLEDYAMHWVRQAPGKGLEW VSGINWNSENIGYADSVKGRFTISRDNAKNSLYLQMNSLRAEDTALY YCAKVPGYSGGWIDAEDDWGQGTMVTVSS |
| 480 | P1-70906 VH K16R | EVQLVESGGGLVQPGRSLRLSCAASGFTLEDYAMHWVRQAPGKGLEW VSGINWNSENIGYADSVKGRFTISRDNAKNSLYLQMNSLRTEDTALY YCAKVPGYSGGWIDAEDDWGQGTMVTVSS |
| 481 | P1-70906 VH T84A | EVQLVESGGGLVQPGKSLRLSCAASGFTLEDYAMHWVRQAPGKGLEW VSGINWNSENIGYADSVKGRFTISRDNAKNSLYLQMNSLRAEDTALY YCAKVPGYSGGWIDAEDDWGQGTMVTVSS |
| 482 | P1-70906 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 483 | P1-70908 (P1-068767_E55A) VH K16R T84A | EVQLVESGGGLVQPGRSLRLSCAASGFTLEDYAMHWVRQAPGKGLEW VSGIDWNSANIGYADSVKGRFTISRDNAKNSLYLQMNSLRAEDTALY YCAKVPGYSGGWIDAEDDWGQGTMVTVSS |
| 484 | P1-70908 VH K16R | EVQLVESGGGLVQPGRSLRLSCAASGFTLEDYAMHWVRQAPGKGLEW VSGIDWNSANIGYADSVKGRFTISRDNAKNSLYLQMNSLRTEDTALY YCAKVPGYSGGWIDAEDDWGQGTMVTVSS |
| 485 | P1-70908 VH T84A | EVQLVESGGGLVQPGKSLRLSCAASGFTLEDYAMHWVRQAPGKGLEW VSGIDWNSANIGYADSVKGRFTISRDNAKNSLYLQMNSLRAEDTALY YCAKVPGYSGGWIDAEDDWGQGTMVTVSS |
| 486 | P1-70908 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 487 | P1-70916 (P1-068767_D52N_E55A) VH K16R T84A | EVQLVESGGGLVQPGRSLRLSCAASGFTLEDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 488 | P1-70916 VH K16R | EVQLVESGGGLVQPGRSLRLSCAASGFTLEDYAMHWVRQAPGKGLEW VSGINWNSANIGYADSVKGRFTISRDNAKNSLYLQMNSLRTEDTALY YCAKVPGYSGGWIDAEDDWGQGTMVTVSS |
| 489 | P1-70916 VH T84A | EVQLVESGGGLVQPGKSLRLSCAASGFTLEDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 490 | P1-70916 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |

-continued

| SEQ ID NO | Name | Sequence |
|---|---|---|
| 491 | P1-72000 (P1-061029_F100fE_V102D) VH | EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSS |
| 492 | P1-72000 (P1-061029_F100fE_V102D) VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK |
| 493 | P1-72000 (P1-061029_F100fE_V102D) HC | EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 494 | P1-72000 (P1-061029_F100fE_V102D) LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 495 | P1-72000 (P1-061029_F100fE_V102D) VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAGGATGACTGGGGCCAAGGGACAATGGTCACCGTCTCTTCA |
| 496 | P1-72000 (P1-061029_F100fE_V102D) VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 497 | P1-72000 (P1-061029_F100fE_V102D) HC DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAGGATGACTGGGGCCAAGGGACAATGGTCACCGTCTCTTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAGAGTTGAGCCCAAATCTTGTGACAAAACTCACACATGCCCACCGTGCCCAGCACCTGAAGCCGAAGGGGCCCCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCCCCGGGTTGA |
| 498 | P1-72000 (P1-061029_F100fE_V102D) LC DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTT |

-continued

| SEQ ID NO | Name | Sequence |
|---|---|---|
| | | CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 499 | P1-72000 (P1-061029_F100fE_V102D) VH K16R T84A | EVQLVESGGGLVQPGRSLRLSCAASGFTLDDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 500 | P1-72000 (P1-061029_F100fE_V102D) VH K16R | EVQLVESGGGLVQPGRSLRLSCAASGFTLDDYAMHWVRQAPGKGLEW VSGINWNSANIGYADSVKGRFTISRDNAKNSLYLQMNSLRTEDTALY YCAKVPGYSGGWIDAEDDWGQGTMVTVSS |
| 501 | P1-72000 (P1-061029_F100fE_V102D) VH T84A | EVQLVESGGGLVQPGKSLRLSCAASGFTLDDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 502 | P1-72000 (P1-061029_F100fE_V102D) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAqCTGAGGACACGGCCTTGTAT TACTGTGCAAAAGTTCCTGGGTATAGCGGTGGCTGGATTGACGCTGA GGATGACTGGGGCCAAGGGACAATGGTCACCGTCTCTTCA |
| 503 | P1-72002 (P1-061029_F100fE) VH | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDVWGQGTMVTVSS |
| 504 | P1-72002 (P1-061029_F100fE) VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 505 | P1-72002 (P1-061029_F100fE) HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 506 | P1-72002 (P1-061029_F100fE) LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 507 | P1-72002 (P1-061029_F100fE) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGTCTGGGGCCAAGGGACAATGGTCACCGTCTCTTCA |
| 508 | P1-72002 (P1-061029_F100fE) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |

-continued

| SEQ ID NO | Name | Sequence |
|---|---|---|
| 509 | P1-72002 (P1-061029_F100fE) HC DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAGGATGTCTGGGGCCAAGGGACAATGGTCACCGTCTCTTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAGAGTTGAGCCCAAATCTTGTGACAAAACTCACACATGCCCACCGTGCCCAGCACCTGAAGCCGAAGGGGCCCCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCCCCGGGTTGA |
| 510 | P1-72002 (P1-061029_F100fE) LC DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAG |
| 511 | P1-72002 (P1-061029_F100fE) VH K16R T84A | EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAEDVWGQGTMVTVSS |
| 512 | P1-72002 (P1-061029_F100fE) VH K16R | EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSS |
| 513 | P1-72002 (P1-061029_F100fE) VH T84A | EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAEDDWGQGTMVTVSS |
| 514 | P1-72002 (P1-061029_F100fE) VH K16R T84A DNA | GAGGTGCAGCTGGTGGAGTCTGGGGGAGGCTTGGTACAGCCTGGCAgGTCCCTGAGACTCTCCTGTGCAGCCTCTGGATTCACCCTTGATGATTATGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAgCTGAGGACACGGCCTTGTATTACTGTGCAAAAGTTCCTGGGTATAGCGGTGGCTGGATTGACGCTGAGGATGTCTGGGGCCAAGGGACAATGGTCACCGTCTCTTCA |
| 515 | P1-72004 (P1-061029_V102D) VH | EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSS |
| 516 | P1-72004 (P1-061029_V102D) VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK |

-continued

| SEQ ID NO | Name | Sequence |
|---|---|---|
| 517 | P1-72004 (P1-061029_V102D) HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVELFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 518 | P1-72004 (P1-061029_V102D) LC | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 519 | P1-72004 (P1-061029_V102D) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGACTGGGGCCAAGGGACAATGGTCACCGTCTCTTCA |
| 520 | P1-72004 (P1-061029_V102D) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 521 | P1-72004 (P1-061029_ V102D) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGACTGGGGCCAAGGGACAATGGTCACCGTCTCTTCAGCGTCGA CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 522 | P1-72004 (P1-061029_V102D) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC |

-continued

| SEQ ID NO | Name | Sequence |
|---|---|---|
| | | GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 523 | P1-72004 (P1-061029_V102D) VH K16R T84A | EVQLVESGGGLVQPGRSLRLSCAASGFTLDDYAMHWVRQAPGKGLEW VSGINWNSANIGYADSVKGRFTISRDNAKNSLYLQMNSLRAEDTALY YCAKVPGYSGGWIDAFDDWGQGTMVTVSS |
| 524 | P1-72004 (P1-061029_V102D) VH K16R | EVQLVESGGGLVQPGRSLRLSCAASGFTLDDYAMHWVRQAPGKGLEW VSGINWNSANIGYADSVKGRFTISRDNAKNSLYLQMNSLRTEDTALY YCAKVPGYSGGWIDAFDDWGQGTMVTVSS |
| 525 | P1-72004 (P1-061029_V102D) VH T84A | EVQLVESGGGLVQPGKSLRLSCAASGFTLDDYAMHWVRQAPGKGLEW VSGINWNSANIGYADSVKGRFTISRDNAKNSLYLQMNSLRAEDTALY YCAKVPGYSGGWIDAFDDWGQGTMVTVSS |
| 526 | P1-72004 (P1-061029_V102D) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTTT TGATGACTGGGGCCAAGGGACAATGGTCACCGTCTCTTCA |
| 527 | P1-72006 (P1-061029_Y32E) VH | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 528 | P1-72006 (P1-061029_Y32E) VL | EIVLTQSPGTLSLSPGERATLSCRASQSVSSSYLAWYQQKPGQAPRL LIYGASSRATGIPDRESGSGSGTDFTLTISRLEPEDFAVYYCQQYGS SPFTFGPGTKVDIK |
| 529 | P1-72006 (P1-061029_Y32E) HC | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 530 | P1-72006 (P1-061029_Y32E) LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 531 | P1-72006 (P1-061029_Y32E) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 532 | P1-72006 (P1-061029_Y32E) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 533 | P1-72006 (P1-061029_Y32E) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCAGCGTCGA |

-continued

| SEQ ID NO | Name | Sequence |
|---|---|---|
| | | CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 534 | P1-72006 (P1-061029_Y32E) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 535 | P1-72006 (P1-061029_Y32E) VH K16R T84A | EVQLVESGGGLVQPGRSLRLSCAASGFTLDDEAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 536 | P1-72006 (P1-061029_Y32E) VH K16R | EVQLVESGGGLVQPGRSLRLSCAASGFTLDDEAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 537 | P1-72006 (P1-061029_Y32E) VH T84A | EVQLVESGGGLVQPGKSLRLSCAASGFTLDDEAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 538 | P1-72006 (P1-061029_Y32E) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 539 | P1-72008 (P1-061029_Y32E F100fE) VH | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAEDVWGQGTMVTVSS |
| 540 | P1-72008 (P1-061029 Y32E_F100fE) VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 541 | P1-72008 (P1-061029 Y32E_F100fE) HC | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKEN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

-continued

| SEQ ID NO | Name | Sequence |
|---|---|---|
| 542 | P1-72008 (P1-061029 Y32E_F100fE) LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSENRGEC |
| 543 | P1-72008 (P1-061029 Y32E_F100fE) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGTCTGGGGCCAAGGGACAATGGTCACCGTCTCTTCA |
| 544 | P1-72008 (P1-061029 Y32E_F100fE) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 545 | P1-72008 (P1-061029 Y32E_F100fE) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGTCTGGGGCCAAGGGACAATGGTCACCGTCTCTTCAGCGTCGA CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 546 | P1-72008 (P1-061029 Y32E_F100fE) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 547 | P1-72008 (P1-061029 Y32E_F100fE) VH K16R T84A | EVQLVESGGGLVQPGRSLRLSCAASGFTLDDEAMHWVRQAPGKGLEW VSGINWNSANIGYADSVKGRFTISRDNAKNSLYLQMNSLRAEDTALY YCAKVPGYSGGWIDAEDVWGQGTMVTVSS |

-continued

| SEQ ID NO | Name | Sequence |
|---|---|---|
| 548 | P1-72008 (P1-061029 Y32E_F100fE) VH K16R | EVQLVESGGGLVQPGRSLRLSCAASGFTLDDEAMHWVRQAPGKGLEW<br>VSGINWNSANIGYADSVKGRFTISRDNAKNSLYLQMNSLRTEDTALY<br>YCAKVPGYSGGWIDAEDVWGQGTMVTVSS |
| 549 | P1-72008 (P1-061029 Y32E_F100fE) VH T84A | EVQLVESGGGLVQPGKSLRLSCAASGFTLDDEAMHWVRQAPGKGLEW<br>VSGINWNSANIGYADSVKGRFTISRDNAKNSLYLQMNSLRAEDTALY<br>YCAKVPGYSGGWIDAEDVWGQGTMVTVSS |
| 550 | P1-72008 (P1-061029 Y32E_F100fE) VH K16R T84A DNA | GAGGTGCAGCTGGTGGAGTCTGGGGGAGGCTTGGTACAGCCTGGCAg<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAgCTGAGGACACGGCCTTGTAT<br>TACTGTGCAAAAGTTCCTGGGTATAGCGGTGGCTGGATTGACGCTGA<br>GGATGTCTGGGGCCAAGGGACAATGGTCACCGTCTCTTCA |
| 551 | VISTA. 4 VH 41F11 With signal sequence, which is underlined | MEFGLSWVFLVAIIKGVQCQVQLVESGGGLVKPGGSLRLSCAASGFT<br>FSDYYMSWIRQAPGKGLEWVSYISNSGSPIYYADSVKGRFTISRDNA<br>KNSLYLQMNSLRAEDTAVYYCARDLPGWYFDLWGRGTLVTVSS |
| 552 | VISTA. 4 VK1 VL 41F11 With signal sequence, which is underlined | MEAPAQLLFLLLLWLPDTTGEIVLTQSPATLSLSPGERATLSCRASQ<br>SVSSYLAWYQQKPGQAPRLLIYDASNRATGIPARFSASGSGTDFTLT<br>ISSLEPEDFAVYYCQQRNNWPRTFGQGTKVEIK |
| 553 | VISTA. 4 VK2 VL 41F11 With signal sequence, which is underlined | MDMRVLAQLLGLLLLCFPGARCDIQMTQSPSSLSASVGDRVTITCRA<br>SQGISSWLAWYQQKPEKAPKSLIYAASSLQSGVPSRFSGSGSGTDFT<br>LTISSLQPEDFATYYCQQYNSYPRTFGQGTKVEIK |
| 554 | VISTA. 4 VK3 VL 41F11 With signal sequence, which is underlined | METPAQLLFLLLLWLPDTTGEIVLTQSPGTLSLSPGERATLSCRASQ<br>SVSSSYLAWYQQKPGQAPRLLIYGASSRATGIPDRFSGSGSGTDFTL<br>TISRLEPEDFAVYYCQQYGSSPWTFGQGTKVEIK |
| 555 | VISTA. 4 VH DNA 41F11 With signal sequence, which is underlined | ATGGAGTTTGGGCTGAGCTGGGTTTTCCTTGTTGCTATTATAAAAGG<br>TGTCCAGTGTCAGGTGCAGTTGGTGGAGTCTGGGGGAGGCTTGGTCA<br>AGCCTGGAGGGTCCCTGAGACTCTCCTGTGCAGCCTCTGGATTCACC<br>TTCAGTGACTATTACATGAGCTGGATCCGCCAGGCTCCAGGGAAGGG<br>GCTGGAGTGGGTTTCATACATTAGTAATAGTGGTAGTCCCATATACT<br>ACGCAGACTCTGTGAAGGGCCGATTCACCATCTCCAGGGACAACGCC<br>AAGAACTCACTGTATCTGCAAATGAACAGCCTGAGAGCCGAGGACAC<br>GGCCGTGTATTACTGTGCGAGAGATCTCCCGGGCTGGTACTTCGATC<br>TCTGGGGCCGTGGCACCCTGGTCACTGTCTCCTCA |
| 556 | VISTA. 4 VK1 VL DNA With signal sequence, which is underlined | ATGGAAGCCCCAGCTCAGCTTCTCTTCCTCCTGCTACTCTGGCTCCC<br>AGATACCACCGGAGAAATTGTGTTGACACAGTCTCCAGCCACCCTGT<br>CTTTGTCTCCAGGGGAAAGAGCCACCCTCTCCTGCAGGGCCAGTCAG<br>AGTGTTAGCAGCTACTTAGCCTGGTACCAACAGAAACCTGGCCAGGC<br>TCCCAGGCTCCTCATCTATGATGCATCCAACAGGGCCACTGGCATCC<br>CAGCCAGGTTCAGTGCCAGTGGGTCTGGGACAGACTTCACTCTCACC<br>ATCAGCAGCCTAGAGCCTGAAGATTTTGCAGTTTATTACTGTCAGCA<br>GCGTAACAACTGGCCTCGGACGTTCGGCCAAGGGACCAAGGTGGAAA<br>TCAAA |
| 557 | VISTA. 4.A64G VK1 VL With signal sequence, which is underlined | MEAPAQLLFLLLLWLPDTTGEIVLTQSPATLSLSPGERATLSCRASQ<br>SVSSYLAWYQQKPGQAPRLLIYDASNRATGIPARFSGSGSGTDFTLT<br>ISSLEPEDFAVYYCQQRNNWPRTFGQGTKVEIK |
| 558 | VISTA. 4.A64G LC With signal sequence, which is underlined | MEAPAQLLFLLLLWLPDTTGEIVLTQSPATLSLSPGERATLSCRASQ<br>SVSSYLAWYQQKPGQAPRLLIYDASNRATGIPARFSGSGSGTDFTLT<br>ISSLEPEDFAVYYCQQRNNWPRTFGQGTKVEIKRTVAAPSVFIFPPS<br>DEQLKSGTASVVCLLNNFYPREAKVQWKVDNALQSGNSQESVTEQDS<br>KDSTYSLSSTLTLSKADYEKHKVYACEVTHQGLSSPVTKSENRGEC |

-continued

| SEQ ID NO | Name | Sequence |
|---|---|---|
| 559 | VISTA. 5 VH | AVQLQESGPGLVRPSQSLSLTCTVTDYSITSDYAWNWIRQFPGSKLE WLGFIGYSGNTNYNPSLESRISITRHTSKNQFFLHLNSMTTEDTATY YCARSLYGGSHWYFDVWGAGTTVTVSS |
| 560 | VISTA. 5 VK1, VL | DIVLTQSPASLAVSLGQRATISCRGSESVEYYGTILMQWYQQKPGQP PKLLIYGASNVESGVPARFSGSGSGTDESLNIHPVEEDDIAMYFCQQ SRKVPWTFGGGTKLEIK |
| 561 | VISTA. 5 VH DNA | GCTGTGCAGCTTCAGGAGTCGGGACCTGGCCTGGTGAGACCTTCTCA GTCTCTGTCCCTCACCTGCACTGTCACTGACTACTCAATCACCAGTG ATTATGCCTGGAACTGGATCCGGCAGTTTCCAGGAAGCAAACTGGAG TGGCTGGGCTTCATAGGCTACAGTGGTAACACTAACTACAACCCATC TCTCGAAAGTCGAATCTCTATCACTCGACACACATCCAAGAACCAGT TCTTCCTGCACTTGAATTCTATGACTACTGAGGACACAGCCACATAT TACTGTGCAAGATCCCTCTACGGTGGTAGTCACTGGTACTTCGATGT CTGGGGCGCAGGGACCACGGTCACCGTCTCCTCA |
| 562 | VISTA. 5 VK1, VL DNA | GACATTGTGCTCACCCAATCTCCAGCTTCTTTGGCTGTGTCTCTAGG GCAGAGAGCCACCATCTCCTGCAGAGGCAGTGAAAGTGTTGAATATT ATGGCACAATTTTAATGCAGTGGTACCAACAGAAACCAGGACAGCCA CCCAAACTCCTCATCTATGGTGCATCCAACGTAGAATCTGGGGTCCC TGCCAGGTTTAGTGGCAGTGGGTCTGGGACAGACTTCAGCCTCAACA TCCATCCTGTGGAGGAGGATGATATTGCAATGTATTTCTGTCAGCAA AGTAGGAAGGTTCCGTGGACGTTCGGTGGAGGCACCAAGCTGGAAAT CAAA |
| 563 | CDR1 of P1-061029 with substitutions | GFTX1X2DX3AMH where X1 = D or L, X2 = E or D, X3 = E o rY |
| 564 | CDR2 of P1-061029 with substitutions | GIX4WX5SX6X7IGYADSVK where X4 = D or N, X5 = D or N, X6 = D, E, H, or A, X7 = D, E, H, ot N |
| 565 | CDR3 of P1-061029 with substitutions | VPGYSX8GWIDAX9DX10 where X8 = E, H, or G, X9 = E, D, or F, X10 = D, E, or V |
| 566 | Region 1 hVISTA epitope | LGPVDKGHDVTF |
| 567 | Region 2 hVISTA epitope | RRPIRNLTFQDL |
| 568 | Region 3 hVISTA epitope | VVEIRHHHSEHRVHGAME |
| 569 | P1-061015 VL with T85V substitution | EIVLTQSPATLSLSPGERATLSCRASQSVSSSYLAWYQQKPGQAPRL LIYDASNRATGIPARFSGSGSGTDFTLTISSLEPEDFAVYCQQYNSY PYTFGQGTKLEIK |
| 570 | P1-077835 (P1-068744 E31S) VH | QVQLVESGGGVVQPGRSLRLSCAASGFTFSSYAMHWVRQAPGKGLEW VAHIWYDGSNKYEADSVKGRFTISRDNSKNTLYLQMNSLRAEDTAVY YCARDSGFYESYYFDEWGQGTLVTVSS |
| 571 | P1-077835 (P1-068744 E31S) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCACATATATGGTATGATGGAAGTAATAAATACGAGGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAATCGTACTACTTTGACGA GTGGGGCCAGGGAACCCTGGTCACCGTCTCCTCA |
| 572 | P1-077835 (P1-068744 E31S) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 573 | P1-077835 (P1-068744 E31S) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |

-continued

| SEQ ID NO | Name | Sequence |
|---|---|---|
| 574 | P1-077837 (P1-068744 H50I) VH | QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYESYYFDEWGQGTLVTVSS |
| 575 | P1-077837 (P1-068744 H50I) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCAATTATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACGAGTGGGGCCAGGGAACCCTGGTCACCGTCTCCTCA |
| 576 | P1-077837 (P1-068744 H50I) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 577 | P1-077837 (P1-068744 H50I) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 578 | P1-077839 (P1-068744 E59Y) VH | QVQLVESGGGVVQPGRSLRLSCAASGFTFSEYAMHWVRQAPGKGLEWVAHIWYDGSNKYYADSVKGRFTISRDNSKNTLYLQMNSLRAEDTAVYYCARDSGFYESYYFDEWGQGTLVTVSS |
| 579 | P1-077839 (P1-068744 E59Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCACATATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACGAGTGGGGCCAGGGAACCCTGGTCACCGTCTCCTCA |
| 580 | P1-077839 (P1-068744 E59Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 581 | P1-077839 (P1-068744 E59Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 582 | P1-077841 (P1-068744 E100S) VH | QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYSSYYFDEWGQGTLVTVSS |
| 583 | P1-077841 (P1-068744 E100S) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCACATATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACTCCTCGTACTACTTTGACGAGTGGGGCCAGGGAACCCTGGTCACCGTCTCCTCA |
| 584 | P1-077841 (P1-068744 E100S) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 585 | P1-077841 (P1-068744 E100S) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |

-continued

| SEQ ID NO | Name | Sequence |
|---|---|---|
| 586 | P1-077843 (P1-068744 E102Y) VH | QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDYWGQGTLVTVSS |
| 587 | P1-077843 (P1-068744 E102Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCACATATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACTACTGGGGCCAGGGAACCCTGGTCACCGTCTCCTCA |
| 588 | P1-077843 (P1-068744 E102Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 589 | P1-077843 (P1-068744 E102Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 590 | P1-077845 (P1-068744 E31S H50I ) VH | QVQLVESGGGVVQPGRSLRLSCAASGFTFSSYAMHWVRQAPGKGLEWVAIIWYDGSNKYEADSVKGRFTISRDNSKNTLYLQMNSLRAEDTAVYYCARDSGFYESYYFDEWGQGTLVTVSS |
| 591 | P1-077845 (P1-068744 E31S H50I) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCCATGCACTGGGTCCGCCAGGCTCCAGGCAAGGGGCTGGAGTGGGTGGCAATTATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACGAGTGGGGCCAGGGAACCCTGGTCACCGTCTCCTCA |
| 592 | P1-077845 (P1-068744 E31S H50I) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 593 | P1-077845 (P1-068744 E31S H50I) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 594 | P1-077847 (P1-068744 H50I E59Y) VH | QVQLVESGGGVVQPGRSLRLSCAASGFTFSEYAMHWVRQAPGKGLEWVAIIWYDGSNKYYADSVKGRFTISRDNSKNTLYLQMNSLRAEDTAVYYCARDSGFYESYYFDEWGQGTLVTVSS |
| 595 | P1-077847 (P1-068744 H50I E59Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCAATTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACGAGTGGGGCCAGGGAACCCTGGTCACCGTCTCCTCA |
| 596 | P1-077847 (P1-068744 H50I E59Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 597 | P1-077847 (P1-068744 H50I E59Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |

-continued

| SEQ ID NO | Name | Sequence |
|---|---|---|
| 598 | P1-077849 (P1-068744 E59Y E100S) VH | QVQLVESGGGVVQPGRSLRLSCAASGFTFSEYAMHWVRQAPGKGLEW VAHIWYDGSNKYYADSVKGRFTISRDNSKNTLYLQMNSLRAEDTAVY YCARDSGFYSSYYFDEWGQGTLVTVSS |
| 599 | P1-077849 (P1-068744 E59Y E100S) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCATGCACTGGGTCCGCCAGGCTCCAGGCAAGGGGCTGGAGTGG GTGGCACATATATGGTATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACGA GTGGGGCCAGGGAACCCTGGTCACCGTCTCCTCA |
| 600 | P1-077849 (P1-068744 E59Y E100S) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 601 | P1-077849 (P1-068744 E59Y E100S) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 602 | P1-077851 (P1-068744 E100S E102Y) VH | QVQLVESGGGVVQPGRSLRLSCAASGFTFSEYAMHWVRQAPGKGLEW VAHIWYDGSNKYEADSVKGRFTISRDNSKNTLYLQMNSLRAEDTAVY YCARDSGFYSSYYFDYWGQGTLVTVSS |
| 603 | P1-077851 (P1-068744 E100S E102Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCATGCACTGGGTCCGCCAGGCTCCAGGCAAGGGGCTGGAGTGG GTGGCACATATATGGTATGATGGAAGTAATAAATACGAGGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACTA CTGGGGCCAGGGAACCCTGGTCACCGTCTCCTCA |
| 604 | P1-077851 (P1-068744 E100S E102Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 605 | P1-077851 (P1-068744 E100S E102Y) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 606 | P1-077853 (P1-068744 E31S E102Y) VH | QVQLVESGGGVVQPGRSLRLSCAASGFTFSSYAMHWVRQAPGKGLEW VAHIWYDGSNKYEADSVKGRFTISRDNSKNTLYLQMNSLRAEDTAVY YCARDSGFYESYYFDYWGQGTLVTVSS |
| 607 | P1-077853 (P1-068744 E31S E102Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCACATATATGGTATGATGGAAGTAATAAATACGAGGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAATCGTACTACTTTGACTA CTGGGGCCAGGGAACCCTGGTCACCGTCTCCTCA |
| 608 | P1-077853 (P1-068744 E31S E102Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 609 | P1-077853 (P1-068744 E31S E102Y) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |

-continued

| SEQ ID NO | Name | Sequence |
|---|---|---|
| 610 | P1-077855 (P1-068744 E31S E59Y) VH | QVQLVESGGGVVQPGRSLRLSCAASGFTFSSYAMHWVRQAPGKGLEWVAHIWYDGSNKYYADSVKGRFTISRDNSKNTLYLQMNSLRAEDTAVYYCARDSGFYESYYFDEWGQGTLVTVSS |
| 611 | P1-077855 (P1-068744 E31S E59Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCCATGCACTGGGTCCGCCAGGCTCCAGGCAAGGGGCTGGAGTGGGTGGCACATATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACGAGTGGGGCCAGGGAACCCTGGTCACCGTCTCCTCA |
| 612 | P1-077855 (P1-068744 E31S E59Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 613 | P1-077855 (P1-068744 E31S E59Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 614 | P1-077857 (P1-068744 E31S E100S) VH | QVQLVESGGGVVQPGRSLRLSCAASGFTFSSYAMHWVRQAPGKGLEWVAHIWYDGSNKYEADSVKGRFTISRDNSKNTLYLQMNSLRAEDTAVYYCARDSGFYSSYYFDEWGQGTLVTVSS |
| 615 | P1-077857 (P1-068744 E31S E100S) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCCATGCACTGGGTCCGCCAGGCTCCAGGCAAGGGGCTGGAGTGGGTGGCACATATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACTCCTCGTACTACTTTGACGAGTGGGGCCAGGGAACCCTGGTCACCGTCTCCTCA |
| 616 | P1-077857 (P1-068744 E31S E100S) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 617 | P1-077857 (P1-068744 E31S E100S) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 618 | P1-077859 (P1-068744 H50I E100S) VH | QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYSSYYFDEWGQGTLVTVSS |
| 619 | P1-077859 (P1-068744 H50I E100S) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCAATTATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACTCCTCGTACTACTTTGACGAGTGGGGCCAGGGAACCCTGGTCACCGTCTCCTCA |
| 620 | P1-077859 (P1-068744 H50I E100S) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 621 | P1-077859 (P1-068744 H50I E100S) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |

-continued

| SEQ ID NO | Name | Sequence |
|---|---|---|
| 622 | P1-077861 (P1-068744 H50I E102Y) VH | QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYESYYFDYWGQGTLVTVSS |
| 623 | P1-077861 (P1-068744 H50I E102Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCAATTATATGGTATGATGGAAGTAATAAATACGAGGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACTACTGGGGCCAGGGAACCCTGGTCACCGTCTCCTCA |
| 624 | P1-077861 (P1-068744 H50I E102Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 625 | P1-077861 (P1-068744 H50I E102Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 626 | P1-077863 (P1-068744 E59Y E102Y) VH | QVQLVESGGGVVQPGRSLRLSCAASGFTFSEYAMHWVRQAPGKGLEWVAHIWYDGSNKYYADSVKGRFTISRDNSKNTLYLQMNSLRAEDTAVYYCARDSGFYESYYFDYWGQGTLVTVSS |
| 627 | P1-077863 (P1-068744 E59Y E102Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGAGTATGCCATGCACTGGGTCCGCCAGGCTCCAGGCAAGGGGCTGGAGTGGGTGGCACATATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGAATCGTACTACTTTGACTACTGGGGCCAGGGAACCCTGGTCACCGTCTCCTCA |
| 628 | P1-077863 (P1-068744 E59Y E102Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 629 | P1-077863 (P1-068744 E59Y E102Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 630 | P1-077865 (P1-068748 H31S) VH | QVQLVESGGGVVQPGRSLRLSCAASGFTFSSHAMHWVRQAPGKGLEWVAIIWYDGSNDDYADSVKGRFTISRDNSKNTLYLQMNSLRAEDTAVYYCARDSGFYDSYYFDYWGQGTLVTVSS |
| 631 | P1-077865 (P1-068748 H31S) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCCATGCCATGCACTGGGTCCGCCAGGCTCCAGGCAAGGGGCTGGAGTGGGTGGCAATTATATGGTATGATGGAAGTAATGACGACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGACTCGTACTACTTTGACTACTGGGGCCAGGGAACCCTGGTCACCGTCTCCTCA |
| 632 | P1-077865 (P1-068748 H31S) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 633 | P1-077865 (P1-068748 H31S) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |

-continued

| SEQ ID NO | Name | Sequence |
|---|---|---|
| 634 | P1-077867 (P1-068748 H32Y) VH | QVQLVESGGGVVQPGRSLRLSCAASGFTFSHYAMHWVRQAPGKGLEWVAIIWYDGSNDDYADSVKGRFTISRDNSKNTLYLQMNSLRAEDTAVYYCARDSGFYDSYYFDYWGQGTLVTVSS |
| 635 | P1-077867 (P1-068748 H32Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTCACTATGCCATGCACTGGGTCCGCCAGGCTCCAGGCAAGGGGCTGGAGTGGGTGGCAATTATATGGTATGATGGAAGTAATGACGACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGACTCGTACTACTTTGACTACTGGGGCCAGGGAACCCTGGTCACCGTCTCCTCA |
| 636 | P1-077867 (P1-068748 H32Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 637 | P1-077867 (P1-068748 H32Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 638 | P1-077869 (P1-068748 D57K) VH | QVQLVESGGGVVQPGRSLRLSCAASGFTFSHHAMHWVRQAPGKGLEWVAIIWYDGSNKDYADSVKGRFTISRDNSKNTLYLQMNSLRAEDTAVYYCARDSGFYDSYYFDYWGQGTLVTVSS |
| 639 | P1-077869 (P1-068748 D57K) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTCACCATGCCATGCACTGGGTCCGCCAGGCTCCAGGCAAGGGGCTGGAGTGGGTGGCAATTATATGGTATGATGGAAGTAATAAAGACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGACTCGTACTACTTTGACTACTGGGGCCAGGGAACCCTGGTCACCGTCTCCTCA |
| 640 | P1-077869 (P1-068748 D57K) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 641 | P1-077869 (P1-068748 D57K) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |
| 642 | P1-077871 (P1-068748 D58Y) VH | QVQLVESGGGVVQPGRSLRLSCAASGFTFSHHAMHWVRQAPGKGLEWVAIIWYDGSNDYYADSVKGRFTISRDNSKNTLYLQMNSLRAEDTAVYYCARDSGFYDSYYFDYWGQGTLVTVSS |
| 643 | P1-077871 (P1-068748 D58Y) VH DNA | CAGGTGCAGCTGGTGGAGTCTGGGGGAGGCGTGGTCCAGCCTGGGAGGTCCCTGAGACTCTCCTGTGCAGCGTCTGGATTCACCTTCAGTCACCATGCCATGCACTGGGTCCGCCAGGCTCCAGGCAAGGGGCTGGAGTGGGTGGCAATTATATGGTATGATGGAAGTAATGACTACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGACTCGTACTACTTTGACTACTGGGGCCAGGGAACCCTGGTCACCGTCTCCTCA |
| 644 | P1-077871 (P1-068748 D58Y) VL | EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK |
| 645 | P1-077871 (P1-068748 D58Y) VL DNA | GAAATTGTGTTGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGCGGCAGTGGATCTGGGACAGATTTCACTCTCACCATCAGCAGCCTGGAGCCTGAAGATTTTGCAACTTATTACTGCCAACAGTATAATAGTTACCCGTACACTTTTGGCCAGGGGACCAAGCTGGAGATCAAA |

-continued

| SEQ ID NO | Name | Sequence |
|---|---|---|
| 646 | P1-077873 (P1-068748 D100S) VH | QVQLVESGGGVVQPGRSLRLSCAASGFTFSHHAMHWVRQAPGKGLEW VAIIWYDGSNDDYADSVKGRFTISRDNSKNTLYLQMNSLRAEDTAVY YCARDSGFYSSYYFDYWGQGTLVTVSS |
| 647 | P1-077873 (P1-068748 D100S) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACC ATGCCATGCACTGGGTCCGCCAGGCTCCAGGCAAGGGGCTGGAGTGG GTGGCAATTATATGGTATGATGGAAGTAATGACGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACTA CTGGGGCCAGGGAACCCTGGTCACCGTCTCCTCA |
| 648 | P1-077873 (P1-068748 D100S) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 649 | P1-077873 (P1-068748 D100S) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 650 | P1-077875 (P1-068748 H31S H32Y) VH | QVQLVESGGGVVQPGRSLRLSCAASGFTFSSYAMHWVRQAPGKGLEW VAIIWYDGSNDDYADSVKGRFTISRDNSKNTLYLQMNSLRAEDTAVY YCARDSGFYDSYYFDYWGQGTLVTVSS |
| 651 | P1-077875 (P1-068748 H31S H32Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCT ATGCCATGCACTGGGTCCGCCAGGCTCCAGGCAAGGGGCTGGAGTGG GTGGCAATTATATGGTATGATGGAAGTAATGACGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 652 | P1-077875 (P1-068748 H31S H32Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 653 | P1-077875 (P1-068748 H32Y D57K) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 654 | P1-077877 (P1-068748 H32Y D57K) VH | QVQLVESGGGVVQPGRSLRLSCAASGFTFSHYAMHWVRQAPGKGLEW VAIIWYDGSNKDYADSVKGRFTISRDNSKNTLYLQMNSLRAEDTAVY YCARDSGFYDSYYFDYWGQGTLVTVSS |
| 655 | P1-077877 (P1-068748 H32Y D57K) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACT ATGCCATGCACTGGGTCCGCCAGGCTCCAGGCAAGGGGCTGGAGTGG GTGGCAATTATATGGTATGATGGAAGTAATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 656 | P1-077877 (P1-068748 H32Y D57K) VL | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACT ATGCCATGCACTGGGTCCGCCAGGCTCCAGGCAAGGGGCTGGAGTGG GTGGCAATTATATGGTATGATGGAAGTAATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 657 | P1-077877 (P1-068748 H32Y D57K) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT |

-continued

| SEQ ID NO | Name | Sequence |
|---|---|---|
| | | CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 658 | P1-077879 (P1-068748 D57K D58Y) VH | QVQLVESGGGVVQPGRSLRLSCAASGFTFSHHAMHWVRQAPGKGLEW VAIIWYDGSNKYYADSVKGRFTISRDNSKNTLYLQMNSLRAEDTAVY YCARDSGFYDSYYFDYWGQGTLVTVSS |
| 659 | P1-077879 (P1-068748 D57K D58Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACC ATGCCATGCACTGGGTCCGCCAGGCTCCAGGCAAGGGGCTGGAGTGG GTGGCAATTATATGGTATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 660 | P1-077879 (P1-068748 D57K D58Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 661 | P1-077879 (P1-068748 D57K D58Y) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 662 | P1-077881 (P1-068748 D58Y D100S) VH | QVQLVESGGGVVQPGRSLRLSCAASGFTFSHHAMHWVRQAPGKGLEW VAIIWYDGSNDYYADSVKGRFTISRDNSKNTLYLQMNSLRAEDTAVY YCARDSGFYSSYYFDYWGQGTLVTVSS |
| 663 | P1-077881 (P1-068748 D58Y D100S) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACC ATGCCATGCACTGGGTCCGCCAGGCTCCAGGCAAGGGGCTGGAGTGG GTGGCAATTATATGGTATGATGGAAGTAATGACTACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACTA CTGGGGCCAGGGAACCCTGGTCACCGTCTCCTCA |
| 664 | P1-077881 (P1-068748 D58Y D100S) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 665 | P1-077881 (P1-068748 D58Y D100S) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 666 | P1-077883 (P1-068748 H31S D57K) VH | QVQLVESGGGVVQPGRSLRLSCAASGFTFSSHAMHWVRQAPGKGLEW VAIIWYDGSNKDYADSVKGRFTISRDNSKNTLYLQMNSLRAEDTAVY YCARDSGFYDSYYFDYWGQGTLVTVSS |
| 667 | P1-077883 (P1-068748 H31S D57K) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCC ATGCCATGCACTGGGTCCGCCAGGCTCCAGGCAAGGGGCTGGAGTGG GTGGCAATTATATGGTATGATGGAAGTAATAAAGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 668 | P1-077883 (P1-068748 H31S D57K) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 669 | P1-077883 (P1-068748 H31S D57K) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC |

-continued

| SEQ ID NO | Name | Sequence |
|---|---|---|
| | | TGGAGCCTGAAGATTTTGCAACTTATTACTGCCAACAGTATAATAGT TACCCGTACACTTTTGGCCAGGGGACCAAGCTGGAGATCAAA |
| 670 | P1-077885 (P1-068748 H31S D58Y) VH | QVQLVESGGGVVQPGRSLRLSCAASGFTFSSHAMHWVRQAPGKGLEW VAIIWYDGSNDYYADSVKGRFTISRDNSKNTLYLQMNSLRAEDTAVY YCARDSGFYDSYYFDYWGQGTLVTVSS |
| 671 | P1-077885 (P1-068748 H31S D58Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCC ATGCCATGCACTGGGTCCGCCAGGCTCCAGGCAAGGGGCTGGAGTGG GTGGCAATTATATGGTATGATGGAAGTAATGACTACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 672 | P1-077885 (P1-068748 H31S D58Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 673 | P1-077885 (P1-068748 H31S D58Y) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 674 | P1-077887 (P1-068748 H31S D100S) VH | QVQLVESGGGVVQPGRSLRLSCAASGFTFSSHAMHWVRQAPGKGLEW VAIIWYDGSNDDYADSVKGRFTISRDNSKNTLYLQMNSLRAEDTAVY YCARDSGFYSSYYFDYWGQGTLVTVSS |
| 675 | P1-077887 (P1-068748 H31S D100S) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTAGCC ATGCCATGCACTGGGTCCGCCAGGCTCCAGGCAAGGGGCTGGAGTGG GTGGCAATTATATGGTATGATGGAAGTAATGACGACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACTCCTCGTACTACTTTGACTA CTGGGGCCAGGGAACCCTGGTCACCGTCTCCTCA |
| 676 | P1-077887 (P1-068748 H31S D100S) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 677 | P1-077887 (P1-068748 H31S D100S) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 678 | P1-077889 (P1-068748 H32Y D58Y) VH | QVQLVESGGGVVQPGRSLRLSCAASGFTFSHYAMHWVRQAPGKGLEW VAIIWYDGSNDYYADSVKGRFTISRDNSKNTLYLQMNSLRAEDTAVY YCARDSGFYDSYYFDYWGQGTLVTVSS |
| 679 | P1-077889 (P1-068748 H32Y D58Y) VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTCACT ATGCCATGCACTGGGTCCGCCAGGCTCCAGGCAAGGGGCTGGAGTGG GTGGCAATTATATGGTATGATGGAAGTAATGACTACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGACTCGTACTACTTTGACTA CTGGGGCCAGGGAACCCTGGTCACCGTCTCCTCA |
| 680 | P1-077889 (P1-068748 H32Y D58Y) VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 681 | P1-077889 (P1-068748 H32Y D58Y) VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT |

-continued

| SEQ ID NO | Name | Sequence |
|---|---|---|
| | | CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 682 | P1-077891 (P1-068748 H32Y D100S) VH | QVQLVESGGGVVQPGRSLRLSCAASGFTFSHYAMHWVRQAPGKGLEW<br>VAIIWYDGSNDDYADSVKGRFTISRDNSKNTLYLQMNSLRAEDTAVY<br>YCARDSGFYSSYYFDYWGQGTLVTVSS |
| 683 | P1-077891 (P1-068748 H32Y D100S) VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTCACT<br>ATGCCATGCACTGGGTCCGCCAGGCTCCAGGCAAGGGGCTGGAGTGG<br>GTGGCAATTATATGGTATGATGGAAGTAATGACGACTATGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACTCCTCGTACTACTTTGACTA<br>CTGGGGCCAGGGAACCCTGGTCACCGTCTCCTCA |
| 684 | P1-077891 (P1-068748 H32Y D100S) VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |
| 685 | P1-077891 (P1-068748 H32Y D100S) VL DNA | GAAATTGTGTTGACACAGTCTCCAGCCACCCTGTCTTTGTCTCCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT<br>CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 686 | P1-077893 (P1-068748 D57K D100S) VH | QVQLVESGGGVVQPGRSLRLSCAASGFTFSHHAMHWVRQAPGKGLEW<br>VAIIWYDGSNKDYADSVKGRFTISRDNSKNTLYLQMNSLRAEDTAVY<br>YCARDSGFYSSYYFDYWGQGTLVTVSS |
| 687 | P1-077893 (P1-068748 D57K D100S) VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTCACC<br>ATGCCATGCACTGGGTCCGCCAGGCTCCAGGCAAGGGGCTGGAGTGG<br>GTGGCAATTATATGGTATGATGGAAGTAATAAAGACTATGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACTCCTCGTACTACTTTGACTA<br>CTGGGGCCAGGGAACCCTGGTCACCGTCTCCTCA |
| 688 | P1-077893 (P1-068748 D57K D100S) VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |
| 689 | P1-077893 (P1-068748 D57K D100S) VL DNA | GAAATTGTGTTGACACAGTCTCCAGCCACCCTGTCTTTGTCTCCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT<br>CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 690 | CDR1 based on P1-061015 and P1-068744 | GFTFS$X_1$YAMH, wherein $X_1$ is E or S |
| 691 | CDR2 based on P1-061015 and P1-068744 | $X_2$IWYDGSNKY$X_3$ADSVKG, wherein $X_2$ is H or I, and $X_3$ is E or : |
| 692 | CDR3 based on P1-061015 and P1-068744 | DSGFY$X_4$SYYFD$X_5$, wherein $X_4$ is E or S and $X_5$ is E or Y |
| 693 | CDR1 based on P1-061015 and P1-068748 | GFTFS$X_1X_2$AMH, wherein $X_1$ is H or S, and $X_2$ is H or Y |
| 694 | CDR2 based on P1-061015 and P1-068748 | IIWYDGSN$X_3X_4$YADSVKG, wherein $X_3$ is D or K, and $X_4$ is D or Y |

-continued

| SEQ ID NO | Name | Sequence |
|---|---|---|
| 695 | CDR3 based on P1-061015 and P1-068748 | DSGFYX$_5$SYYFDY, wherein X$_5$ is D |

SEQUENCE LISTING (738 sequences)

SEQ ID NO: 1 - protein, 311 aa, Homo sapiens
  misc_feature (1)..(311): hVISTA (with leader sequence)
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 2 - protein, 279 aa, Homo sapiens
  misc_feature (1)..(279): hVISTA (no leader sequence)
  misc_feature (155)..(155): X = D or E
FKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQXSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 3 - protein, 412 aa, Homo sapiens
  misc_feature (1)..(412): Human PSGL-1 isoform 2 precursor, with signal peptide
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 4 - protein, 395 aa, Homo sapiens
  misc_feature (1)..(395): Human PSGL-1 isoform 2, without signal peptide
LQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 5 - protein, 226 aa, Homo sapiens
  misc_feature (1)..(226): Human PSGL-1 isoform 2 ECD, with signal peptide
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 6 - protein, 209 aa, Homo sapiens
  misc_feature (1)..(209): Human PSGL-1 isoform 2 ECD, without signal peptide
LQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 7 - protein, 254 aa, Homo sapiens
  misc_feature (1)..(254): Human PSGL-1 ECD (N-terminal positions 42 to 295 of a full length Human PSGL-1)
QATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSV

SEQ ID NO: 8 - protein, 428 aa, Homo sapiens
  misc_feature (1)..(428): HumPSGL-1 isoform 1 precursor, with signal peptide
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 9 - protein, 395 aa, Homo sapiens; identical to SEQ ID NO: 4
  misc_feature (1)..(395): Human PSGL-1, without signal peptide

SEQ ID NO: 10 - protein, 242 aa, Homo sapiens
  misc_feature (1)..(242): Human PSGL-1 ECD, with signal peptide
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 11 - protein, 123 aa, Artificial Sequence
  Synthetic: P1-069059 VH
EVQLVESGGGLVQPGKSLRLSCAASGFTLEDYAMHWVRQAPGKGLEWVSGINWNSDHIGYADSVKGRFTISRDNAKNSLYLQMNSLRTEDTALYYCAKVPGYSGGWIDAEDDWGQGTMVTVSS

SEQ ID NO: 12 - protein, 108 aa, Artificial Sequence
  Synthetic: P1-069059 VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 13 - protein, 452 aa, Artificial Sequence
  Synthetic: P1-069059 IgG1.3 HC
EVQLVESGGGLVQPGKSLRLSCAASGFTLEDYAMHWVRQAPGKGLEWVSGINWNSDHIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 14 - protein, 215 aa, Artificial Sequence
  Synthetic: P1-069059 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 123 aa, Artificial Sequence
  Synthetic: P1-069061 VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDAEDDWGQGTMVTVSS

SEQ ID NO: 16 - protein, 108 aa, Artificial Sequence; identical to SEQ ID NO: 12
  Synthetic: P1-069061 VL

SEQ ID NO: 17 - protein, 452 aa, Artificial Sequence
  Synthetic: P1-069061 IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 215 aa, Artificial Sequence; identical to SEQ ID NO: 14
  Synthetic: P1-069061 LC

SEQ ID NO: 19 - protein, 123 aa, Artificial Sequence
  Synthetic: P1-069063 VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDADDEWGQGTMVTVSS

SEQ ID NO: 20 - protein, 108 aa, Artificial Sequence; identical to SEQ ID NO: 12
  Synthetic: P1-069063 VL

SEQ ID NO: 21 - protein, 452 aa, Artificial Sequence
  Synthetic: P1-069063 IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDADDEWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 22 - protein, 215 aa, Artificial Sequence; identical to SEQ ID NO: 14
  Synthetic: P1-069063 LC

SEQ ID NO: 23 - protein, 123 aa, Artificial Sequence
  Synthetic: P1-069065 VH
EVQLVESGGGLVQPGKSLRLSCAASGFTLEDEAMHWVRQAPGKGLEWVSGINWNSDDIGYADSVKGRFTISRDNAKNSLYLQMNSLRTEDTALYYCAKVPGYSGGWIDAFDVWGQGTMVTVSS

SEQ ID NO: 24 - protein, 108 aa, Artificial Sequence; identical to SEQ ID NO: 12
  Synthetic: P1-069065 VL

SEQ ID NO: 25 - protein, 452 aa, Artificial Sequence
  Synthetic: P1-069065 IgG1.3 HC
EVQLVESGGGLVQPGKSLRLSCAASGFTLEDEAMHWVRQAPGKGLEWVSGINWNSDDIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 26 - protein, 215 aa, Artificial Sequence; identical to SEQ ID NO: 14
  Synthetic: P1-069065 LC

SEQ ID NO: 27 - protein, 123 aa, Artificial Sequence
  Synthetic: P1-069067 VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDEWGQGTMVTVSS

SEQ ID NO: 28 - protein, 108 aa, Artificial Sequence; identical to SEQ ID NO: 12
  Synthetic: P1-069067 VL

SEQ ID NO: 29 - protein, 452 aa, Artificial Sequence
  Synthetic: P1-069067 IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDEWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 30 - protein, 215 aa, Artificial Sequence; identical to SEQ ID NO: 14
  Synthetic: P1-069067 LC

SEQ ID NO: 31 - protein, 123 aa, Artificial Sequence
  Synthetic: P1-069069 VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDVWGQGTMVTVSS

SEQ ID NO: 32 - protein, 108 aa, Artificial Sequence; identical to SEQ ID NO: 12
  Synthetic: P1-069069 VL

SEQ ID NO: 33 - protein, 452 aa, Artificial Sequence
  Synthetic: P1-069069 IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 34 - protein, 215 aa, Artificial Sequence; identical to SEQ ID NO: 14
  Synthetic: P1-069069 LC

SEQ ID NO: 35 - protein, 123 aa, Artificial Sequence
  Synthetic: P1-069071 VH
EVQLVESGGGLVQPGKSLRLSCAASGFTLEDEAMHWVRQAPGKGLEWVSGINWNSADIGYADSVKGRFTISRDNAKNSLYLQMNSLRTEDTALYYCAKVPGYSEGWIDAFDVWGQGTMVTVSS

SEQ ID NO: 36 - protein, 108 aa, Artificial Sequence; identical to SEQ ID NO: 12
  Synthetic: P1-069071 VL

SEQ ID NO: 37 - protein, 452 aa, Artificial Sequence
  Synthetic: P1-069071 IgG1.3 HC
EVQLVESGGGLVQPGKSLRLSCAASGFTLEDEAMHWVRQAPGKGLEWVSGINWNSADIGYADSVKGRFTISRDNAKNSLYLQMNSLRTEDTALYYCAKVPGYSEGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 38 - protein, 215 aa, Artificial Sequence; identical to SEQ ID NO: 14
  Synthetic: P1-069071 LC

SEQ ID NO: 39 - protein, 123 aa, Artificial Sequence
  Synthetic: P1-069073 VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSGGWIDAEDVWGQGTMVTVSS

SEQ ID NO: 40 - protein, 108 aa, Artificial Sequence; identical to SEQ ID NO: 12
  Synthetic: P1-069073 VL

SEQ ID NO: 41 - protein, 452 aa, Artificial Sequence
  Synthetic: P1-069073 IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 42 - protein, 215 aa, Artificial Sequence; identical to SEQ ID NO: 14
  Synthetic: P1-069073 LC

SEQ ID NO: 43 - protein, 123 aa, Artificial Sequence
  Synthetic: P1-069075 VH
EVQLVESGGGLVQPGKSLRLSCAASGFTLEDYAMHWVRQAPGKGLEWVSGINWDSAEIGYADSVKGRFTISRDNAKNSLYLQMNSLRTEDTALYYCAKVPGYSHGWIDAEDVWGQGTMVTVSS

SEQ ID NO: 44 - protein, 108 aa, Artificial Sequence; identical to SEQ ID NO: 12
  Synthetic: P1-069075 VL

SEQ ID NO: 45 - protein, 452 aa, Artificial Sequence
  Synthetic: P1-069075 IgG1.3 HC
EVQLVESGGGLVQPGKSLRLSCAASGFTLEDYAMHWVRQAPGKGLEWVSGINWDSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 46 - protein, 215 aa, Artificial Sequence; identical to SEQ ID NO: 14
  Synthetic: P1-069075 LC

SEQ ID NO: 47 - protein, 123 aa, Artificial Sequence
  Synthetic: P1-069077 VH
EVQLVESGGGLVQPGKSLRLSCAASGFTLEDEAMHWVRQAPGKGLEWVSGINWNSDEIGYADSVKGRFTISRDNAKNSLYLQMNSLRTEDTALYYCAKVPGYSGGWIDAFDVWGQGTMVTVSS

SEQ ID NO: 48 - protein, 108 aa, Artificial Sequence; identical to SEQ ID NO: 12
  Synthetic: P1-069077 VL

SEQ ID NO: 49 - protein, 452 aa, Artificial Sequence
  Synthetic: P1-069077 IgG1.3 HC
EVQLVESGGGLVQPGKSLRLSCAASGFTLEDEAMHWVRQAPGKGLEWVSGINWNSDEIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 50 - protein, 215 aa, Artificial Sequence; identical to SEQ ID NO: 14
  Synthetic: P1-069077 LC

SEQ ID NO: 51 - protein, 123 aa, Artificial Sequence
  Synthetic: P1-068761 VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 52 - protein, 108 aa, Artificial Sequence; identical to SEQ ID NO: 12
  Synthetic: P1-068761 VL

SEQ ID NO: 53 - protein, 452 aa, Artificial Sequence
  Synthetic: P1-068761 IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 54 - protein, 215 aa, Artificial Sequence; identical to SEQ ID NO: 14
  Synthetic: P1-068761 LC

SEQ ID NO: 55 - protein, 123 aa, Artificial Sequence
  Synthetic: P1-068767 VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 56 - protein, 108 aa, Artificial Sequence; identical to SEQ ID NO: 12
  Synthetic: P1-068767 VL

SEQ ID NO: 57 - protein, 452 aa, Artificial Sequence
  Synthetic: P1-068767 IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 58 - protein, 215 aa, Artificial Sequence; identical to SEQ ID NO: 14
  Synthetic: P1-068767 LC

SEQ ID NO: 59 - protein, 123 aa, Artificial Sequence
  Synthetic: P1-068773 VH
EVQLVESGGGLVQPGKSLRLSCAASGFTLEDYAMHWVRQAPGKGLEWVSGIDWNSDNIGYADSVKGRFTISRDNAKNSLYLQMNSLRTEDTALYYCAKVPGYSGGWIDAEDDWGQGTMVTVSS

SEQ ID NO: 60 - protein, 108 aa, Artificial Sequence; identical to SEQ ID NO: 12
  Synthetic: P1-068773 VL

SEQ ID NO: 61 - protein, 452 aa, Artificial Sequence
  Synthetic: P1-068773 IgG1.3 HC
EVQLVESGGGLVQPGKSLRLSCAASGFTLEDYAMHWVRQAPGKGLEWVSGIDWNSDNIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 62 - protein, 215 aa, Artificial Sequence; identical to SEQ ID NO: 14
  Synthetic: P1-068773 LC

SEQ ID NO: 63 - protein, 123 aa, Artificial Sequence
  Synthetic: P1-068765 VH
EVQLVESGGGLVQPGKSLRLSCAASGFTDEDYAMHWVRQAPGKGLEWVSGINWNSEEIGYADSVKGRFTISRDNAKNSLYLQMNSLRTEDTALYYCAKVPGYSGGWIDAEDDWGQGTMVTVSS

SEQ ID NO: 64 - protein, 108 aa, Artificial Sequence; identical to SEQ ID NO: 12
  Synthetic: P1-068765 VL

SEQ ID NO: 65 - protein, 452 aa, Artificial Sequence
  Synthetic: P1-068765 IgG1.3 HC
EVQLVESGGGLVQPGKSLRLSCAASGFTDEDYAMHWVRQAPGKGLEWVSGINWNSEEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 66 - protein, 215 aa, Artificial Sequence; identical to SEQ ID NO: 14
  Synthetic: P1-068765 LC

SEQ ID NO: 67 - protein, 123 aa, Artificial Sequence
  Synthetic: P1-061029 VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 68 - protein, 108 aa, Artificial Sequence; identical to SEQ ID NO: 12
  Synthetic: P1-061029 VL

SEQ ID NO: 69 - protein, 452 aa, Artificial Sequence
  Synthetic: P1-061029 IgG1.3 HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 70 - protein, 215 aa, Artificial Sequence; identical to SEQ ID NO: 14
  Synthetic: P1-061029 LC

SEQ ID NO: 71 - protein, 123 aa, Artificial Sequence
  Synthetic: P1-068757 VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDDWGQGTMVTVSS

SEQ ID NO: 72 - protein, 108 aa, Artificial Sequence; identical to SEQ ID NO: 12
  Synthetic: P1-068757 VL

SEQ ID NO: 73 - protein, 452 aa, Artificial Sequence
  Synthetic: P1-068757 IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 74 - protein, 215 aa, Artificial Sequence; identical to SEQ ID NO: 14
  Synthetic: P1-068757 LC

SEQ ID NO: 75 - protein, 123 aa, Artificial Sequence
  Synthetic: P1-068771 VH
EVQLVESGGGLVQPGKSLRLSCAASGFTLEDEAMHWVRQAPGKGLEWVSGINWNSHEIGYADSVKGRFTISRDNAKNSLYLQMNSLRTEDTALYYCAKVPGYSGGWIDAEDDWGQGTMVTVSS

SEQ ID NO: 76 - protein, 108 aa, Artificial Sequence; identical to SEQ ID NO: 12
  Synthetic: P1-068771 VL

SEQ ID NO: 77 - protein, 452 aa, Artificial Sequence
  Synthetic: P1-068771 IgG1.3 HC
EVQLVESGGGLVQPGKSLRLSCAASGFTLEDEAMHWVRQAPGKGLEWVSGINWNSHEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 78 - protein, 215 aa, Artificial Sequence; identical to SEQ ID NO: 14
  Synthetic: P1-068771 LC

SEQ ID NO: 79 - protein, 123 aa, Artificial Sequence
  Synthetic: P1-068775 VH
EVQLVESGGGLVQPGKSLRLSCAASGFTLEDEAMHWVRQAPGKGLEWVSGIDWNSEEIGYADSVKGRFTISRDNAKNSLYLQMNSLRTEDTALYYCAKVPGYSHGWIDAEDDWGQGTMVTVSS

SEQ ID NO: 80 - protein, 108 aa, Artificial Sequence; identical to SEQ ID NO: 12
  Synthetic: P1-068775 VL

SEQ ID NO: 81 - protein, 452 aa, Artificial Sequence
  Synthetic: P1-068775 IgG1.3 HC
EVQLVESGGGLVQPGKSLRLSCAASGFTLEDEAMHWVRQAPGKGLEWVSGIDWNSEEIGYADSVKGRFTISRDNAKNSLYLQMNSLRTEDTALYYCAKVPGYSHGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 82 - protein, 215 aa, Artificial Sequence; identical to SEQ ID NO: 14
  Synthetic: P1-068775 LC

SEQ ID NO: 83 - protein, 123 aa, Artificial Sequence
  Synthetic: P1-068769 VH
EVQLVESGGGLVQPGKSLRLSCAASGFTLEDEAMHWVRQAPGKGLEWVSGINWNSDHIGYADSVKGRFTISRDNAKNSLYLQMNSLRTEDTALYYCAKVPGYSGGWIDAEDDWGQGTMVTVSS

SEQ ID NO: 84 - protein, 108 aa, Artificial Sequence; identical to SEQ ID NO: 12
  Synthetic: P1-068769 VL

SEQ ID NO: 85 - protein, 452 aa, Artificial Sequence
  Synthetic: P1-068769 IgG1.3 HC
EVQLVESGGGLVQPGKSLRLSCAASGFTLEDEAMHWVRQAPGKGLEWVSGINWNSDHIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 86 - protein, 215 aa, Artificial Sequence; identical to SEQ ID NO: 14
  Synthetic: P1-068769 LC

SEQ ID NO: 87 - protein, 123 aa, Artificial Sequence
  Synthetic: P1-068759 VH
EVQLVESGGGLVQPGKSLRLSCAASGFTLEDEAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 88 - protein, 108 aa, Artificial Sequence; identical to SEQ ID NO: 12
  Synthetic: P1-068759 VL

SEQ ID NO: 89 - protein, 452 aa, Artificial Sequence
  Synthetic: P1-068759 IgG1.3 HC
EVQLVESGGGLVQPGKSLRLSCAASGFTLEDEAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 215 aa, Artificial Sequence; identical to SEQ ID NO: 14
  Synthetic: P1-068759 LC

SEQ ID NO: 91 - protein, 123 aa, Artificial Sequence
  Synthetic: P1-068763 VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSHGWIDAEDVWGQGTMVTVSS

SEQ ID NO: 92 - protein, 108 aa, Artificial Sequence; identical to SEQ ID NO: 12
  Synthetic: P1-068763 VL

SEQ ID NO: 93 - protein, 452 aa, Artificial Sequence
  Synthetic: P1-068763 IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 94 - protein, 215 aa, Artificial Sequence; identical to SEQ ID NO: 14
  Synthetic: P1-068763 LC

SEQ ID NO: 95 - protein, 121 aa, Artificial Sequence
  Synthetic: P1-061015 VH
QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSS

SEQ ID NO: 96 - protein, 108 aa, Artificial Sequence
  Synthetic: P1-061015 VL
EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK

SEQ ID NO: 97 - protein, 450 aa, Artificial Sequence
  Synthetic: P1-061015 IgG1.3 HC
QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 98 - protein, 215 aa, Artificial Sequence
  Synthetic: P1-061015 LC
EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 121 aa, Artificial Sequence
  Synthetic: P1-068748 VH
QVQLVESGGGVVQPGRSLRLSCAASGFTFSHHAMHWVRQAPGKGLEWVAIIWYDGSNDDYADSVKGRFTISRDNSKNTLYLQMNSLRAEDTAVYYCARDSGFYDSYYFDYWGQGTLVTVSS

SEQ ID NO: 100 - protein, 108 aa, Artificial Sequence; identical to SEQ ID NO: 96
  Synthetic: P1-068748 VL

SEQ ID NO: 101 - protein, 450 aa, Artificial Sequence
  Synthetic: P1-068748 IgG1.3 HC
QVQLVESGGGVVQPGRSLRLSCAASGFTFSHHAMHWVRQAPGKGLEWVAIIWYDGSNDDYADSVKGRFTISRDNSKNTLYLQMNSLRAEDTAVYYCARDSGFYDSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 102 - protein, 215 aa, Artificial Sequence; identical to SEQ ID NO: 98
  Synthetic: P1-068748 LC

SEQ ID NO: 103 - protein, 121 aa, Artificial Sequence
  Synthetic: P1-068744 VH
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDEWGQGTLVTVSS

SEQ ID NO: 104 - protein, 108 aa, Artificial Sequence; identical to SEQ ID NO: 96
  Synthetic: P1-068744 VL

SEQ ID NO: 105 - protein, 450 aa, Artificial Sequence
  Synthetic: P1-068744 IgG1.3 HC
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDEWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 106 - protein, 215 aa, Artificial Sequence; identical to SEQ ID NO: 98
  Synthetic: P1-068744 LC

SEQ ID NO: 107 - protein, 121 aa, Artificial Sequence
  Synthetic: P1-068736 VH
QVQLVESGGGVVQPGRSLRLSCAASGFTFSEYAMHWVRQAPGKGLEWVAIDWYDGSNKDYADSVKGRFTISRDNSKNTLYLQMNSLRAEDTAVYYCARDSGFYDSYYFDDWGQGTLVTVSS

SEQ ID NO: 108 - protein, 108 aa, Artificial Sequence; identical to SEQ ID NO: 96
  Synthetic: P1-068736 VL

SEQ ID NO: 109 - protein, 450 aa, Artificial Sequence
  Synthetic: P1-068736 IgG1.3 HC
QVQLVESGGGVVQPGRSLRLSCAASGFTFSEYAMHWVRQAPGKGLEWVAIDWYDGSNKDYADSVKGRFTISRDNSKNTLYLQMNSLRAEDTAVYYCARDSGFYDSYYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 215 aa, Artificial Sequence; identical to SEQ ID NO: 98
  Synthetic: P1-068736 LC

SEQ ID NO: 111 - protein, 121 aa, Artificial Sequence
  Synthetic: P1-068752 VH
QVQLVESGGGVVQPGRSLRLSCAASGFTFSSYAMHWVRQAPGKGLEWVAEIWYDGSNKDYADSVKGRFTISRDNSKNTLYLQMNSLRAEDTAVYYCARDSGFYDSYYFDEWGQGTLVTVSS

SEQ ID NO: 112 - protein, 108 aa, Artificial Sequence; identical to SEQ ID NO: 96
  Synthetic: P1-068752 VL

SEQ ID NO: 113 - protein, 450 aa, Artificial Sequence
  Synthetic: P1-068752 IgG1.3 HC
QVQLVESGGGVVQPGRSLRLSCAASGFTFSSYAMHWVRQAPGKGLEWVAEIWYDGSNKDYADSVKGRFTISRDNSKNTLYLQMNSLRAEDTAVYYCARDSGFYDSYYFDEWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 114 - protein, 215 aa, Artificial Sequence; identical to SEQ ID NO: 98
  Synthetic: P1-068752 LC

SEQ ID NO: 115 - protein, 121 aa, Artificial Sequence
  Synthetic: P1-068740 VH
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYDSYYFDDWGQGTLVTVSS

SEQ ID NO: 116 - protein, 108 aa, Artificial Sequence; identical to SEQ ID NO: 96
  Synthetic: P1-068740 VL

SEQ ID NO: 117 - protein, 450 aa, Artificial Sequence
  Synthetic: P1-068740 IgG1.3 HC
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYDSYYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 118 - protein, 215 aa, Artificial Sequence; identical to SEQ ID NO: 98
  Synthetic: P1-068740 LC

SEQ ID NO: 119 - protein, 121 aa, Artificial Sequence
  Synthetic: P1-068742 VH
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYEDYYFDYWGQGTLVTVSS

SEQ ID NO: 120 - protein, 108 aa, Artificial Sequence; identical to SEQ ID NO: 96
  Synthetic: P1-068742 VL

SEQ ID NO: 121 - protein, 450 aa, Artificial Sequence
  Synthetic: P1-068742 IgG1.3 HC
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYEDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 122 - protein, 215 aa, Artificial Sequence; identical to SEQ ID NO: 98
  Synthetic: P1-068742 LC

SEQ ID NO: 123 - protein, 121 aa, Artificial Sequence
  Synthetic: P1-068746 VH
QVQLVESGGGVVQPGRSLRLSCAASGFTFSSYAMHWVRQAPGKGLEWVAIIWYDGSNHHYADSVKGRFTISRDNSKNTLYLQMNSLRAEDTAVYYCARDSGFYDSYYFDYWGQGTLVTVSS

SEQ ID NO: 124 - protein, 108 aa, Artificial Sequence; identical to SEQ ID NO: 96
  Synthetic: P1-068746 VL

SEQ ID NO: 125 - protein, 450 aa, Artificial Sequence
  Synthetic: P1-068746 IgG1.3 HC
QVQLVESGGGVVQPGRSLRLSCAASGFTFSSYAMHWVRQAPGKGLEWVAIIWYDGSNHHYADSVKGRFTISRDNSKNTLYLQMNSLRAEDTAVYYCARDSGFYDSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 126 - protein, 215 aa, Artificial Sequence; identical to SEQ ID NO: 98
  Synthetic: P1-068746 LC

SEQ ID NO: 127 - protein, 121 aa, Artificial Sequence
  Synthetic: P1-068750 VH
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDEEFYSSYYFDYWGQGTLVTVSS

SEQ ID NO: 128 - protein, 108 aa, Artificial Sequence; identical to SEQ ID NO: 96
  Synthetic: P1-068750 VL

SEQ ID NO: 129 - protein, 450 aa, Artificial Sequence
  Synthetic: P1-068750 IgG1.3 HC
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDEEFYSSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 130 - protein, 215 aa, Artificial Sequence; identical to SEQ ID NO: 98
  Synthetic: P1-068750 LC

SEQ ID NO: 131 - protein, 121 aa, Artificial Sequence
  Synthetic: P1-068738 VH
QVQLVESGGGVVQPGRSLRLSCAASGFTFSEYAHHWVRQAPGKGLEWVAIIWDDGSNHYYADSVKGRFTISRDNSKNTLYLQMNSLRAEDTAVYYCARDSGFYEDYYFDYWGQGTLVTVSS

SEQ ID NO: 132 - protein, 108 aa, Artificial Sequence; identical to SEQ ID NO: 96
  Synthetic: P1-068738 VL

SEQ ID NO: 133 - protein, 450 aa, Artificial Sequence
  Synthetic: P1-068738 IgG1.3 HC
QVQLVESGGGVVQPGRSLRLSCAASGFTFSEYAHHWVRQAPGKGLEWVAIIWDDGSNHYYADSVKGRFTISRDNSKNTLYLQMNSLRAEDTAVYYCARDSGFYEDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 134 - protein, 215 aa, Artificial Sequence; identical to SEQ ID NO: 98
  Synthetic: P1-068738 LC

SEQ ID NO: 135 - protein, 121 aa, Artificial Sequence
  Synthetic: P1-068754 VH
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDSGFHSDYYFDYWGQGTLVTVSS

SEQ ID NO: 136 - protein, 108 aa, Artificial Sequence; identical to SEQ ID NO: 96
  Synthetic: P1-068754 VL

SEQ ID NO: 137 - protein, 450 aa, Artificial Sequence
  Synthetic: P1-068754 IgG1.3 HC
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDSGFHSDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 138 - protein, 215 aa, Artificial Sequence; identical to SEQ ID NO: 98
  Synthetic: P1-068754 LC

SEQ ID NO: 139 - protein, 123 aa, Artificial Sequence; identical to SEQ ID NO: 51
  Synthetic: P1-069293 VH (P1-068761.IgG1f)

SEQ ID NO: 140 - protein, 108 aa, Artificial Sequence; identical to SEQ ID NO: 12
  Synthetic: P1-069293 VL (P1-068761.IgG1f)

SEQ ID NO: 141 - protein, 452 aa, Artificial Sequence
  Synthetic: P1-069293 HC (P1-068761.IgG1f)
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 142 - protein, 215 aa, Artificial Sequence; identical to SEQ ID NO: 14
  Synthetic: P1-069293 LC (P1-068761.IgG1f)

SEQ ID NO: 143 - protein, 123 aa, Artificial Sequence; identical to SEQ ID NO: 55
  Synthetic: P1-069298 VH (P1-068767.IgG1f)

SEQ ID NO: 144 - protein, 108 aa, Artificial Sequence; identical to SEQ ID NO: 12
  Synthetic: P1-069298 VL (P1-068767.IgG1f)

SEQ ID NO: 145 - protein, 452 aa, Artificial Sequence
  Synthetic: P1-069298 HC (P1-068767.IgG1f)
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 146 - protein, 215 aa, Artificial Sequence; identical to SEQ ID NO: 14
  Synthetic: P1-069298 LC (P1-068767.IgG1f)

SEQ ID NO: 147 - protein, 123 aa, Artificial Sequence; identical to SEQ ID NO: 67
  Synthetic: P1-069302 VH (P1-061029.IgG1f)

SEQ ID NO: 148 - protein, 108 aa, Artificial Sequence; identical to SEQ ID NO: 12
  Synthetic: P1-069302 VL (P1-061029.IgG1f)

SEQ ID NO: 149 - protein, 452 aa, Artificial Sequence
  Synthetic: P1-069302 HC (P1-061029.IgG1f)
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 150 - protein, 215 aa, Artificial Sequence; identical to SEQ ID NO: 14
  Synthetic: P1-069302 LC (P1-061029.IgG1f)

SEQ ID NO: 151 - protein, 123 aa, Artificial Sequence; identical to SEQ ID NO: 51
  Synthetic: P1-069312 VH (P1-068761.IgG1f afucosylated)

SEQ ID NO: 152 - protein, 108 aa, Artificial Sequence; identical to SEQ ID NO: 12
  Synthetic: P1-069312 VL (P1-068761.IgG1f afucosylated)

SEQ ID NO: 153 - protein, 452 aa, Artificial Sequence; identical to SEQ ID NO: 141
  Synthetic: P1-069312 HC (P1-068761.IgG1f afucosylated)

SEQ ID NO: 154 - protein, 215 aa, Artificial Sequence; identical to SEQ ID NO: 14
  Synthetic: P1-069312 LC (P1-068761.IgG1f afucosylated)

SEQ ID NO: 155 - protein, 123 aa, Artificial Sequence; identical to SEQ ID NO: 55
  Synthetic: P1-069309 VH (P1-068767.IgG1f afucosylated)

SEQ ID NO: 156 - protein, 108 aa, Artificial Sequence; identical to SEQ ID NO: 12
  Synthetic: P1-069309 VL (P1-068767.IgG1f afucosylated)

SEQ ID NO: 157 - protein, 452 aa, Artificial Sequence; identical to SEQ ID NO: 145
  Synthetic: P1-069309 HC (P1-068767.IgG1f afucosylated)

SEQ ID NO: 158 - protein, 215 aa, Artificial Sequence; identical to SEQ ID NO: 14
  Synthetic: P1-069309 LC (P1-068767.IgG1f afucosylated)

SEQ ID NO: 159 - protein, 123 aa, Artificial Sequence; identical to SEQ ID NO: 67
  Synthetic: P1-069307 VH (P1-061029.IgG1f afucosylated)

SEQ ID NO: 160 - protein, 108 aa, Artificial Sequence; identical to SEQ ID NO: 12
  Synthetic: P1-069307 VL (P1-061029.IgG1f afucosylated)

SEQ ID NO: 161 - protein, 452 aa, Artificial Sequence; identical to SEQ ID NO: 149
  Synthetic: P1-069307 HC (P1-061029.IgG1f afucosylated)

SEQ ID NO: 162 - protein, 215 aa, Artificial Sequence; identical to SEQ ID NO: 14
  Synthetic: P1-069307 LC (P1-061029.IgG1f afucosylated)

SEQ ID NO: 163 - protein, 329 aa, Artificial Sequence
  Synthetic: IgG1.3 (or IgG1.3f) heavy chain constant region (L234A, L235E, G237A)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 107 aa, Artificial Sequence [sequence omitted]

SEQ ID NO: 165 - protein, 163 aa, Homo sapiens
  misc_feature (1)..(163): Human VISTA NP_071436.1 (Fig. 1B)
SFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAA

SEQ ID NO: 166 - protein, 162 aa, Artificial Sequence
  Synthetic: Cyno VISTA XP_005565644.1 (Fig. 1B)
FKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAA

SEQ ID NO: 167 - protein, 159 aa, Artificial Sequence
  Synthetic: Mouse VISTA NP_083008.1 (Fig. 1B)
FKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAA

SEQ ID NO: 168 - protein, 14 aa, Artificial Sequence
  Synthetic: P1-061029 HDR3 chip oligo  (Fig. 7A)
  misc_feature (1)..(1): X = H, D, or E
XPGYSGGWIDAFDV

SEQ ID NO: 169 - protein, 14 aa, Artificial Sequence
  Synthetic: P1-061029 HDR3 chip oligo  (Fig. 7A)
  misc_feature (1)..(2): X = H, D, or E
XXGYSGGWIDAFDV

SEQ ID NO: 170 - protein, 14 aa, Artificial Sequence
  Synthetic: P1-061029 HDR3 chip oligo  (Fig. 7A)
  misc_feature (1)..(1): X = H, D, or E
  misc_feature (3)..(3): X = H, D, or E
XPXYSGGWIDAFDV

SEQ ID NO: 171 - protein, 14 aa, Artificial Sequence
  Synthetic: P1-061029 HDR3 chip oligo  (Fig. 7A)
  misc_feature (1)..(1): X = H, D, or E
  misc_feature (4)..(4): X = H, D, or E
XPGXSGGWIDAFDV

SEQ ID NO: 172 - protein, 14 aa, Artificial Sequence
  Synthetic: P1-061029 HDR3 chip oligo  (Fig. 7A)
  misc_feature (1)..(1): X = H, D, or E
  misc_feature (5)..(5): X = H, D, or E
XPGYXGGWIDAFDV

SEQ ID NO: 173 - protein, 14 aa, Artificial Sequence
  Synthetic: P1-061029 HDR3 chip oligo  (Fig. 7A)
  misc_feature (1)..(1): X = H, D, or E
  misc_feature (6)..(6): X = H, D, or E
XPGYSXGWIDAFDV

SEQ ID NO: 174 - protein, 14 aa, Artificial Sequence
  Synthetic: P1-061029 HDR3 chip oligo  (Fig. 7A)
  misc_feature (1)..(1): X = H, D, or E
  misc_feature (7)..(7): X = H, D, or E
XPGYSGXWIDAFDV

SEQ ID NO: 175 - protein, 14 aa, Artificial Sequence
  Synthetic: P1-061029 HDR3 chip oligo  (Fig. 7A)
  misc_feature (1)..(1): X = H, D, or E
  misc_feature (8)..(8): X = H, D, or E
XPGYSGGXIDAFDV

SEQ ID NO: 176 - protein, 14 aa, Artificial Sequence
  Synthetic: P1-061029 HDR3 chip oligo  (Fig. 7A)
  misc_feature (1)..(1): X = H, D, or E
  misc_feature (9)..(9): X = H, D, or E
XPGYSGGWXDAFDV

SEQ ID NO: 177 - protein, 14 aa, Artificial Sequence
  Synthetic: P1-061029 HDR3 chip oligo  (Fig. 7A)
  misc_feature (1)..(1): X = H, D, or E
  misc_feature (10)..(10): X = H, D, or E
XPGYSGGWIXAFDV

SEQ ID NO: 178 - protein, 14 aa, Artificial Sequence
  Synthetic: P1-061029 HDR3 chip oligo  (Fig. 7A)
  misc_feature (1)..(1): X = H, D, or E
  misc_feature (11)..(11): X = H, D, or E
XPGYSGGWIDXFDV

SEQ ID NO: 179 - protein, 14 aa, Artificial Sequence
  Synthetic: P1-061029 HDR3 chip oligo  (Fig. 7A)
  misc_feature (1)..(1): X = H, D, or E
  misc_feature (12)..(12): X = H, D, or E
XPGYSGGWIDAXDV

SEQ ID NO: 180 - protein, 14 aa, Artificial Sequence
  Synthetic: P1-061029 HDR3 chip oligo  (Fig. 7A)
  misc_feature (1)..(1): X = H, D, or E
  misc_feature (13)..(13): X = H, D, or E
XPGYSGGWIDAFXV

SEQ ID NO: 181 - protein, 14 aa, Artificial Sequence
  Synthetic: P1-061029 HDR3 chip oligo  (Fig. 7A)
  misc_feature (1)..(1): X = H, D, or E
  misc_feature (14)..(14): X = H, D, or E
XPGYSGGWIDAFDX

SEQ ID NO: 182 - protein, 329 aa, Homo sapiens
  misc_feature (1)..(329): IgG1f (human wild-type allotype f) heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 183 - protein, 329 aa, Artificial Sequence
  Synthetic: IgG1.1f  Heavy chain constant region (L234A, L235E, G237A, A330S, P331S)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 184 - protein, 329 aa, Artificial Sequence
  Synthetic: IgG1fa.P238K (or IgG1.P238K) heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGKSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 185 - protein, 123 aa, Artificial Sequence
  Synthetic: P1-070864 P1-068761_E30D VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 186 - protein, 108 aa, Artificial Sequence; identical to SEQ ID NO: 12
  Synthetic: P1-070864 P1-068761_E30D VL

SEQ ID NO: 187 - protein, 452 aa, Artificial Sequence
  Synthetic: P1-070864 P1-068761_E30D IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 215 aa, Artificial Sequence; identical to SEQ ID NO: 14
  Synthetic: P1-070864 P1-068761_E30D LC

SEQ ID NO: 189 - protein, 123 aa, Artificial Sequence
  Synthetic: P1-070866 P1-068761_E32Y VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 190 - protein, 108 aa, Artificial Sequence; identical to SEQ ID NO: 12
  Synthetic: P1-070866 P1-068761_E32Y VL

SEQ ID NO: 191 - protein, 452 aa, Artificial Sequence
  Synthetic: P1-070866 P1-068761_E32Y IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 215 aa, Artificial Sequence; identical to SEQ ID NO: 14
  Synthetic: P1-070866 P1-068761_E32Y LC

SEQ ID NO: 193 - protein, 123 aa, Artificial Sequence
  Synthetic: P1-070868 P1-068761_E55A VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 194 - protein, 108 aa, Artificial Sequence; identical to SEQ ID NO: 12
  Synthetic: P1-070868 P1-068761_E55A VL

SEQ ID NO: 195 - protein, 452 aa, Artificial Sequence
  Synthetic: P1-070868 P1-068761_E55A IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 215 aa, Artificial Sequence; identical to SEQ ID NO: 14
  Synthetic: P1-070868 P1-068761_E55A LC

SEQ ID NO: 197 - protein, 123 aa, Artificial Sequence
  Synthetic: P1-070870 P1-068761_E56N VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 198 - protein, 108 aa, Artificial Sequence; identical to SEQ ID NO: 12
  Synthetic: P1-070870 P1-068761_E56N VL

SEQ ID NO: 199 - protein, 452 aa, Artificial Sequence
  Synthetic: P1-070870 P1-068761_E56N IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 215 aa, Artificial Sequence; identical to SEQ ID NO: 14
  Synthetic: P1-070870 P1-068761_E56N LC

SEQ ID NO: 201 - protein, 123 aa, Artificial Sequence
  Synthetic: P1-070872 P1-068761_H100G VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 202 - protein, 108 aa, Artificial Sequence; identical to SEQ ID NO: 12
  Synthetic: P1-070872 P1-068761_H100G VL

SEQ ID NO: 203 - protein, 452 aa, Artificial Sequence
  Synthetic: P1-070872 P1-068761_H100G IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - protein, 215 aa, Artificial Sequence; identical to SEQ ID NO: 14
  Synthetic: P1-070872 P1-068761_H100G LC

SEQ ID NO: 205 - protein, 123 aa, Artificial Sequence
  Synthetic: P1-070874 P1-068761_E100fF VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 206 - protein, 108 aa, Artificial Sequence; identical to SEQ ID NO: 12
  Synthetic: P1-070874 P1-068761_E100fF VL

SEQ ID NO: 207 - protein, 452 aa, Artificial Sequence
  Synthetic: P1-070874 P1-068761_E100fF IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 215 aa, Artificial Sequence; identical to SEQ ID NO: 14
  Synthetic: P1-070874 P1-068761_E100fF LC

SEQ ID NO: 209 - protein, 123 aa, Artificial Sequence
  Synthetic: P1-070876 P1-068761_E30D_E32Y VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 210 - protein, 108 aa, Artificial Sequence; identical to SEQ ID NO: 12
  Synthetic: P1-070876 P1-068761_E30D_E32Y VL

SEQ ID NO: 211 - protein, 452 aa, Artificial Sequence
  Synthetic: P1-070876 P1-068761_E30D_E32Y IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 215 aa, Artificial Sequence; identical to SEQ ID NO: 14
  Synthetic: P1-070876 P1-068761_E30D_E32Y LC

SEQ ID NO: 213 - protein, 123 aa, Artificial Sequence
  Synthetic: P1-070878 P1-068761_E55A_E56N VH
EVQLVESGGGLVQPGKSLRLSCAASGFTLEDEAMHWVRQAPGKGLEWVSGINWNSANIGYADSVKGRFTISRDNAKNSLYLQMNSLRTEDTALYYCAKVPGYSHGWIDAEDVWGQGTMVTVSS

SEQ ID NO: 214 - protein, 108 aa, Artificial Sequence; identical to SEQ ID NO: 12
  Synthetic: P1-070878 P1-068761_E55A_E56N VL

SEQ ID NO: 215 - protein, 452 aa, Artificial Sequence
  Synthetic: P1-070878 P1-068761_E55A_E56N IgG1.3 HC
EVQLVESGGGLVQPGKSLRLSCAASGFTLEDEAMHWVRQAPGKGLEWVSGINWNSANIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 215 aa, Artificial Sequence; identical to SEQ ID NO: 14
  Synthetic: P1-070878 P1-068761_E55A_E56N LC

SEQ ID NO: 217 - protein, 123 aa, Artificial Sequence
  Synthetic: P1-070880 P1-068761_H100G_E100fF VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAFDVWGQGTMVTVSS

SEQ ID NO: 218 - protein, 108 aa, Artificial Sequence; identical to SEQ ID NO: 12
  Synthetic: P1-070880 P1-068761_H100G_E100fF VL

SEQ ID NO: 219 - protein, 452 aa, Artificial Sequence
  Synthetic: P1-070880 P1-068761_H100G_E100fF IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 220 - protein, 215 aa, Artificial Sequence; identical to SEQ ID NO: 14
  Synthetic: P1-070880 P1-068761_H100G_E100fF LC

SEQ ID NO: 221 - protein, 123 aa, Artificial Sequence
  Synthetic: P1-070882 P1-068761_E32Y_E55A VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 222 - protein, 108 aa, Artificial Sequence; identical to SEQ ID NO: 12
  Synthetic: P1-070882 P1-068761_E32Y_E55A VL

SEQ ID NO: 223 - protein, 452 aa, Artificial Sequence
  Synthetic: P1-070882 P1-068761_E32Y_E55A IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 215 aa, Artificial Sequence; identical to SEQ ID NO: 14
  Synthetic: P1-070882 P1-068761_E32Y_E55A LC

SEQ ID NO: 225 - protein, 123 aa, Artificial Sequence
  Synthetic: P1-070884 P1-068761_E32Y_E56N VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 226 - protein, 108 aa, Artificial Sequence; identical to SEQ ID NO: 12
  Synthetic: P1-070884 P1-068761_E32Y_E56N VL

SEQ ID NO: 227 - protein, 452 aa, Artificial Sequence
  Synthetic: P1-070884 P1-068761_E32Y_E56N IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - protein, 215 aa, Artificial Sequence; identical to SEQ ID NO: 14
  Synthetic: P1-070884 P1-068761_E32Y_E56N LC

SEQ ID NO: 229 - protein, 123 aa, Artificial Sequence
  Synthetic: P1-070886 P1-068761_E32Y_H100G VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 230 - protein, 108 aa, Artificial Sequence; identical to SEQ ID NO: 12
  Synthetic: P1-070886 P1-068761_E32Y_H100G VL

SEQ ID NO: 231 - protein, 452 aa, Artificial Sequence
  Synthetic: P1-070886 P1-068761_E32Y_H100G IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - protein, 215 aa, Artificial Sequence; identical to SEQ ID NO: 14
  Synthetic: P1-070886 P1-068761_E32Y_H100G LC

SEQ ID NO: 233 - protein, 123 aa, Artificial Sequence
  Synthetic: P1-070888 P1-068761_E32Y_E100fF VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 234 - protein, 108 aa, Artificial Sequence; identical to SEQ ID NO: 12
  Synthetic: P1-070888 P1-068761_E32Y_E100fF VL

SEQ ID NO: 235 - protein, 452 aa, Artificial Sequence
  Synthetic: P1-070888 P1-068761_E32Y_E100fF IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 236 - protein, 215 aa, Artificial Sequence; identical to SEQ ID NO: 14
  Synthetic: P1-070888 P1-068761_E32Y_E100fF LC

SEQ ID NO: 237 - protein, 123 aa, Artificial Sequence
  Synthetic: P1-070890 P1-068761_E30D_E55A VH
EVQLVESGGGLVQPGKSLRLSCAASGFTLDDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 238 - protein, 108 aa, Artificial Sequence; identical to SEQ ID NO: 12
  Synthetic: P1-070890 P1-068761_E30D_E55A VL

SEQ ID NO: 239 - protein, 452 aa, Artificial Sequence
  Synthetic: P1-070890 P1-068761_E30D_E55A IgG1.3 HC
EVQLVESGGGLVQPGKSLRLSCAASGFTLDDEAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - protein, 215 aa, Artificial Sequence; identical to SEQ ID NO: 14
  Synthetic: P1-070890 P1-068761_E30D_E55A LC

SEQ ID NO: 241 - protein, 123 aa, Artificial Sequence
  Synthetic: P1-070892 P1-068761_E30D_E56N VH
EVQLVESGGGLVQPGKSLRLSCAASGFTLDDEAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 242 - protein, 108 aa, Artificial Sequence; identical to SEQ ID NO: 12
  Synthetic: P1-070892 P1-068761_E30D_E56N VL

SEQ ID NO: 243 - protein, 452 aa, Artificial Sequence
  Synthetic: P1-070892 P1-068761_E30D_E56N IgG1.3 HC
EVQLVESGGGLVQPGKSLRLSCAASGFTLDDEAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 244 - protein, 215 aa, Artificial Sequence; identical to SEQ ID NO: 14
  Synthetic: P1-070892 P1-068761_E30D_E56N LC

SEQ ID NO: 245 - protein, 123 aa, Artificial Sequence
  Synthetic: P1-070894 P1-068761_E30D_H100G VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 246 - protein, 108 aa, Artificial Sequence; identical to SEQ ID NO: 12
  Synthetic: P1-070894 P1-068761_E30D_H100G VL

SEQ ID NO: 247 - protein, 452 aa, Artificial Sequence
  Synthetic: P1-070894 P1-068761_E30D_H100G IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 248 - protein, 215 aa, Artificial Sequence; identical to SEQ ID NO: 14
  Synthetic: P1-070894 P1-068761_E30D_H100G LC

SEQ ID NO: 249 - protein, 123 aa, Artificial Sequence
  Synthetic: P1-070896 P1-068761_E30D_E100fF VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 250 - protein, 108 aa, Artificial Sequence; identical to SEQ ID NO: 12
  Synthetic: P1-070896 P1-068761_E30D_E100fF VL

SEQ ID NO: 251 - protein, 452 aa, Artificial Sequence
  Synthetic: P1-070896 P1-068761_E30D_E100fF IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 252 - protein, 215 aa, Artificial Sequence; identical to SEQ ID NO: 14
  Synthetic: P1-070896 P1-068761_E30D_E100fF LC

SEQ ID NO: 253 - protein, 123 aa, Artificial Sequence
  Synthetic: P1-070898 P1-068761_E55A_E100fF VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAFDVWGQGTMVTVSS

SEQ ID NO: 254 - protein, 108 aa, Artificial Sequence; identical to SEQ ID NO: 12
  Synthetic: P1-070898 P1-068761_E55A_E100fF VL

SEQ ID NO: 255 - protein, 452 aa, Artificial Sequence
  Synthetic: P1-070898 P1-068761_E55A_E100fF IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 256 - protein, 215 aa, Artificial Sequence; identical to SEQ ID NO: 14
  Synthetic: P1-070898 P1-068761_E55A_E100fF LC

SEQ ID NO: 257 - protein, 123 aa, Artificial Sequence
  Synthetic: P1-070900 P1-068761_E56N_H100G VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSGGWIDAEDVWGQGTMVTVSS

SEQ ID NO: 258 - protein, 108 aa, Artificial Sequence; identical to SEQ ID NO: 12
  Synthetic: P1-070900 P1-068761_E56N_H100G VL

SEQ ID NO: 259 - protein, 452 aa, Artificial Sequence
  Synthetic: P1-070900 P1-068761_E56N_H100G IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 260 - protein, 215 aa, Artificial Sequence; identical to SEQ ID NO: 14
  Synthetic: P1-070900 P1-068761_E56N_H100G LC

SEQ ID NO: 261 - protein, 123 aa, Artificial Sequence
  Synthetic: P1-070902 P1-068761_E56N_E100fF VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAFDVWGQGTMVTVSS

SEQ ID NO: 262 - protein, 108 aa, Artificial Sequence; identical to SEQ ID NO: 12
  Synthetic: P1-070902 P1-068761_E56N_E100fF VL

SEQ ID NO: 263 - protein, 452 aa, Artificial Sequence
  Synthetic: P1-070902 P1-068761_E56N_E100fF IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 215 aa, Artificial Sequence; identical to SEQ ID NO: 14
  Synthetic: P1-070902 P1-068761_E56N_E100fF LC

SEQ ID NO: 265 - protein, 123 aa, Artificial Sequence
  Synthetic: P1-070904 P1-068767_E30D VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 266 - protein, 108 aa, Artificial Sequence; identical to SEQ ID NO: 12
  Synthetic: P1-070904 P1-068767_E30D VL

SEQ ID NO: 267 - protein, 452 aa, Artificial Sequence
  Synthetic: P1-070904 P1-068767_E30D IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 215 aa, Artificial Sequence; identical to SEQ ID NO: 14
  Synthetic: P1-070904 P1-068767_E30D LC

SEQ ID NO: 269 - protein, 123 aa, Artificial Sequence
  Synthetic: P1-070906 P1-068767_D52N VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 270 - protein, 108 aa, Artificial Sequence; identical to SEQ ID NO: 12
  Synthetic: P1-070906 P1-068767_D52N VL

SEQ ID NO: 271 - protein, 452 aa, Artificial Sequence
  Synthetic: P1-070906 P1-068767_D52N IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 272 - protein, 215 aa, Artificial Sequence; identical to SEQ ID NO: 14
  Synthetic: P1-070906 P1-068767_D52N LC

SEQ ID NO: 273 - protein, 123 aa, Artificial Sequence
  Synthetic: P1-070908 P1-068767_E55A VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 274 - protein, 108 aa, Artificial Sequence; identical to SEQ ID NO: 12
  Synthetic: P1-070908 P1-068767_E55A VL

SEQ ID NO: 275 - protein, 452 aa, Artificial Sequence
  Synthetic: P1-070908 P1-068767_E55A IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 215 aa, Artificial Sequence; identical to SEQ ID NO: 14
  Synthetic: P1-070908 P1-068767_E55A LC

SEQ ID NO: 277 - protein, 123 aa, Artificial Sequence
  Synthetic: P1-070910 P1-068767_E100fF VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDDWGQGTMVTVSS

SEQ ID NO: 278 - protein, 108 aa, Artificial Sequence; identical to SEQ ID NO: 12
  Synthetic: P1-070910 P1-068767_E100fF VL

SEQ ID NO: 279 - protein, 452 aa, Artificial Sequence
  Synthetic: P1-070910 P1-068767_E100fF IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 280 - protein, 215 aa, Artificial Sequence; identical to SEQ ID NO: 14
  Synthetic: P1-070910 P1-068767_E100fF LC

SEQ ID NO: 281 - protein, 123 aa, Artificial Sequence
  Synthetic: P1-070912 P1-068767_D102V VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDVWGQGTMVTVSS

SEQ ID NO: 282 - protein, 108 aa, Artificial Sequence; identical to SEQ ID NO: 12
  Synthetic: P1-070912 P1-068767_D102V VL

SEQ ID NO: 283 - protein, 452 aa, Artificial Sequence
  Synthetic: P1-070912 P1-068767_D102V IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 215 aa, Artificial Sequence; identical to SEQ ID NO: 14
  Synthetic: P1-070912 P1-068767_D102V LC

SEQ ID NO: 285 - protein, 123 aa, Artificial Sequence
  Synthetic: P1-070914 P1-068767_E30D_D52N VH
EVQLVESGGGLVQPGKSLRLSCAASGFTLDDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 286 - protein, 108 aa, Artificial Sequence; identical to SEQ ID NO: 12
  Synthetic: P1-070914 P1-068767_E30D_D52N VL

SEQ ID NO: 287 - protein, 452 aa, Artificial Sequence
  Synthetic: P1-070914 P1-068767_E30D_D52N IgG1.3 HC
EVQLVESGGGLVQPGKSLRLSCAASGFTLDDYAMHWVRQAPGKGLEWVSGINWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 215 aa, Artificial Sequence; identical to SEQ ID NO: 14
  Synthetic: P1-070914 P1-068767_E30D_D52N LC

SEQ ID NO: 289 - protein, 123 aa, Artificial Sequence
  Synthetic: P1-070916 P1-068767_D52N_E55A VH
EVQLVESGGGLVQPGKSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 290 - protein, 108 aa, Artificial Sequence; identical to SEQ ID NO: 12
  Synthetic: P1-070916 P1-068767_D52N_E55A VL

SEQ ID NO: 291 - protein, 452 aa, Artificial Sequence
  Synthetic: P1-070916 P1-068767_D52N_E55A IgG1.3 HC
EVQLVESGGGLVQPGKSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 292 - protein, 215 aa, Artificial Sequence; identical to SEQ ID NO: 14
  Synthetic: P1-070916 P1-068767_D52N_E55A LC

SEQ ID NO: 293 - protein, 123 aa, Artificial Sequence
  Synthetic: P1-070918 P1-068767_E55A_E100fF VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAFDDWGQGTMVTVSS

SEQ ID NO: 294 - protein, 108 aa, Artificial Sequence; identical to SEQ ID NO: 12
  Synthetic: P1-070918 P1-068767_E55A_E100fF VL

SEQ ID NO: 295 - protein, 452 aa, Artificial Sequence
  Synthetic: P1-070918 P1-068767_E55A_E100fF IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 296 - protein, 215 aa, Artificial Sequence; identical to SEQ ID NO: 14
  Synthetic: P1-070918 P1-068767_E55A_E100fF LC

SEQ ID NO: 297 - protein, 123 aa, Artificial Sequence
  Synthetic: P1-070920 P1-068767_E100fF_D102V VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDVWGQGTMVTVSS

SEQ ID NO: 298 - protein, 108 aa, Artificial Sequence; identical to SEQ ID NO: 12
  Synthetic: P1-070920 P1-068767_E100fF_D102V VL

SEQ ID NO: 299 - protein, 452 aa, Artificial Sequence
  Synthetic: P1-070920 P1-068767_E100fF_D102V IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 300 - protein, 215 aa, Artificial Sequence; identical to SEQ ID NO: 14
  Synthetic: P1-070920 P1-068767_E100fF_D102V LC

SEQ ID NO: 301 - protein, 123 aa, Artificial Sequence
  Synthetic: P1-070922 P1-068767_E30D_E55A VH
EVQLVESGGGLVQPGKSLRLSCAASGFTLDDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 302 - protein, 108 aa, Artificial Sequence; identical to SEQ ID NO: 12
  Synthetic: P1-070922 P1-068767_E30D_E55A VL

SEQ ID NO: 303 - protein, 452 aa, Artificial Sequence
  Synthetic: P1-070922 P1-068767_E30D_E55A IgG1.3 HC
EVQLVESGGGLVQPGKSLRLSCAASGFTLDDYAMHWVRQAPGKGLEWVSGIDWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 304 - protein, 215 aa, Artificial Sequence; identical to SEQ ID NO: 14
  Synthetic: P1-070922 P1-068767_E30D_E55A LC

SEQ ID NO: 305 - protein, 123 aa, Artificial Sequence
  Synthetic: P1-070924 P1-068767_E30D_E100fF VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAFDDWGQGTMVTVSS

SEQ ID NO: 306 - protein, 108 aa, Artificial Sequence; identical to SEQ ID NO: 12
  Synthetic: P1-070924 P1-068767_E30D_E100fF VL

SEQ ID NO: 307 - protein, 452 aa, Artificial Sequence
  Synthetic: P1-070924 P1-068767_E30D_E100fF IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 308 - protein, 215 aa, Artificial Sequence; identical to SEQ ID NO: 14
  Synthetic: P1-070924 P1-068767_E30D_E100fF LC

SEQ ID NO: 309 - protein, 123 aa, Artificial Sequence
  Synthetic: P1-070926 P1-068767_E30D_D102V VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDVWGQGTMVTVSS

SEQ ID NO: 310 - protein, 108 aa, Artificial Sequence; identical to SEQ ID NO: 12
  Synthetic: P1-070926 P1-068767_E30D_D102V VL

SEQ ID NO: 311 - protein, 452 aa, Artificial Sequence
  Synthetic: P1-070926 P1-068767_E30D_D102V IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 312 - protein, 215 aa, Artificial Sequence; identical to SEQ ID NO: 14
  Synthetic: P1-070926 P1-068767_E30D_D102V LC

SEQ ID NO: 313 - protein, 123 aa, Artificial Sequence
  Synthetic: P1-070928 P1-068767_D52N_E100fF VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAFDDWGQGTMVTVSS

SEQ ID NO: 314 - protein, 108 aa, Artificial Sequence; identical to SEQ ID NO: 12
  Synthetic: P1-070928 P1-068767_D52N_E100fF VL

SEQ ID NO: 315 - protein, 452 aa, Artificial Sequence
  Synthetic: P1-070928 P1-068767_D52N_E100fF IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 316 - protein, 215 aa, Artificial Sequence; identical to SEQ ID NO: 14
  Synthetic: P1-070928 P1-068767_D52N_E100fF LC

SEQ ID NO: 317 - protein, 123 aa, Artificial Sequence
  Synthetic: P1-070930 P1-068767_D52N_D102V VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDVWGQGTMVTVSS

SEQ ID NO: 318 - protein, 108 aa, Artificial Sequence; identical to SEQ ID NO: 12
  Synthetic: P1-070930 P1-068767_D52N_D102V VL

SEQ ID NO: 319 - protein, 452 aa, Artificial Sequence
  Synthetic: P1-070930 P1-068767_D52N_D102V IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 320 - protein, 215 aa, Artificial Sequence; identical to SEQ ID NO: 14
  Synthetic: P1-070930 P1-068767_D52N_D102V LC

SEQ ID NO: 321 - protein, 123 aa, Artificial Sequence
  Synthetic: P1-070932 P1-068767_E55A_D102V VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDVWGQGTMVTVSS

SEQ ID NO: 322 - protein, 108 aa, Artificial Sequence; identical to SEQ ID NO: 12
  Synthetic: P1-070932 P1-068767_E55A_D102V VL

SEQ ID NO: 323 - protein, 452 aa, Artificial Sequence
  Synthetic: P1-070932 P1-068767_E55A_D102V IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 324 - protein, 215 aa, Artificial Sequence; identical to SEQ ID NO: 14
  Synthetic: P1-070932 P1-068767_E55A_D102V LC

SEQ ID NO: 325 - protein, 169 aa, Artificial Sequence
  Synthetic: hVISTA-ECD  6-His tag
AFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESENITAHHHHHHH

SEQ ID NO: 326 - protein, 169 aa, Artificial Sequence
  Synthetic: Cyno VISTA-ECD  6-His tag
AFKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAHHHHHHH

SEQ ID NO: 327 - DNA, 369 bp, Artificial Sequence
  Synthetic: P1-069059 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgaccatataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 328 - DNA, 324 bp, Artificial Sequence
  Synthetic: P1-069059 VL DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggaccaaagtggatatcaaa

SEQ ID NO: 329 - DNA, 369 bp, Artificial Sequence
  Synthetic: P1-069061 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 330 - DNA, 324 bp, Artificial Sequence; identical to SEQ ID NO: 328
  Synthetic: P1-069061 VL DNA

SEQ ID NO: 331 - DNA, 369 bp, Artificial Sequence
  Synthetic: P1-069063 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgaatggggccaagggacaatggtcaccgtctcttca

SEQ ID NO: 332 - DNA, 324 bp, Artificial Sequence; identical to SEQ ID NO: 328
  Synthetic: P1-069063 VL DNA

SEQ ID NO: 333 - DNA, 369 bp, Artificial Sequence
  Synthetic: P1-069065 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgacgacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 334 - DNA, 324 bp, Artificial Sequence; identical to SEQ ID NO: 328
  Synthetic: P1-069065 VL DNA

SEQ ID NO: 335 - DNA, 369 bp, Artificial Sequence
  Synthetic: P1-069067 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgaatggggccaagggacaatggtcaccgtctcttca

SEQ ID NO: 336 - DNA, 324 bp, Artificial Sequence; identical to SEQ ID NO: 328
  Synthetic: P1-069067 VL DNA

SEQ ID NO: 337 - DNA, 369 bp, Artificial Sequence
  Synthetic: P1-069069 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgtctggggccaagggacaatggtcaccgtctcttca

SEQ ID NO: 338 - DNA, 324 bp, Artificial Sequence; identical to SEQ ID NO: 328
  Synthetic: P1-069069 VL DNA

SEQ ID NO: 339 - DNA, 369 bp, Artificial Sequence
  Synthetic: P1-069071 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgctgacataggctatgcggactctgtgaagggccgattcaccatctccagagacaacgccaagaactccctgtatctgcaaatgaacagtctgagaactgaggacacggccttgtattactgtgcaaaagttcctgggtatagcgaaggctggattgacgcttttgatgtctggggccaagggacaatggtcaccgtctcttca

SEQ ID NO: 340 - DNA, 324 bp, Artificial Sequence; identical to SEQ ID NO: 328
  Synthetic: P1-069071 VL DNA

SEQ ID NO: 341 - DNA, 369 bp, Artificial Sequence
  Synthetic: P1-069073 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 342 - DNA, 324 bp, Artificial Sequence; identical to SEQ ID NO: 328
  Synthetic: P1-069073 VL DNA

SEQ ID NO: 343 - DNA, 369 bp, Artificial Sequence
  Synthetic: P1-069075 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattgggacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 344 - DNA, 324 bp, Artificial Sequence; identical to SEQ ID NO: 328
  Synthetic: P1-069075 VL DNA

SEQ ID NO: 345 - DNA, 369 bp, Artificial Sequence
  Synthetic: P1-069077 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgacgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 346 - DNA, 324 bp, Artificial Sequence; identical to SEQ ID NO: 328
  Synthetic: P1-069077 VL DNA

SEQ ID NO: 347 - DNA, 369 bp, Artificial Sequence
  Synthetic: P1-068761 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 348 - DNA, 324 bp, Artificial Sequence; identical to SEQ ID NO: 328
  Synthetic: P1-068761 VL DNA

SEQ ID NO: 349 - DNA, 369 bp, Artificial Sequence
  Synthetic: P1-068767 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 350 - DNA, 324 bp, Artificial Sequence; identical to SEQ ID NO: 328
  Synthetic: P1-068767 VL DNA

SEQ ID NO: 351 - DNA, 369 bp, Artificial Sequence
  Synthetic: P1-068773 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgataacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 352 - DNA, 324 bp, Artificial Sequence; identical to SEQ ID NO: 328
  Synthetic: P1-068773 VL DNA

SEQ ID NO: 353 - DNA, 369 bp, Artificial Sequence
  Synthetic: P1-068765 VH DNA
gaggtgcagctggtggagtctgggggaggcttggtacagcctggcaagtccctgagactctcctgtgcagcctctggattcaccgatgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 354 - DNA, 324 bp, Artificial Sequence; identical to SEQ ID NO: 328
  Synthetic: P1-068765 VL DNA

SEQ ID NO: 355 - DNA, 369 bp, Artificial Sequence
  Synthetic: P1-061029 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 356 - DNA, 324 bp, Artificial Sequence; identical to SEQ ID NO: 328
  Synthetic: P1-061029 VL DNA

SEQ ID NO: 357 - DNA, 369 bp, Artificial Sequence
  Synthetic: P1-068757 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 358 - DNA, 324 bp, Artificial Sequence; identical to SEQ ID NO: 328
  Synthetic: P1-068757 VL DNA

SEQ ID NO: 359 - DNA, 369 bp, Artificial Sequence
  Synthetic: P1-068771 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtcatgagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 360 - DNA, 324 bp, Artificial Sequence; identical to SEQ ID NO: 328
  Synthetic: P1-068771 VL DNA

SEQ ID NO: 361 - DNA, 369 bp, Artificial Sequence
  Synthetic: P1-068775 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattgattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgactggggccaagggacaatggtcaccgtctcttca

SEQ ID NO: 362 - DNA, 324 bp, Artificial Sequence; identical to SEQ ID NO: 328
  Synthetic: P1-068775 VL DNA

SEQ ID NO: 363 - DNA, 369 bp, Artificial Sequence
  Synthetic: P1-068769 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgatcacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 364 - DNA, 324 bp, Artificial Sequence; identical to SEQ ID NO: 328
  Synthetic: P1-068769 VL DNA

SEQ ID NO: 365 - DNA, 369 bp, Artificial Sequence
  Synthetic: P1-068759 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 366 - DNA, 324 bp, Artificial Sequence; identical to SEQ ID NO: 328
  Synthetic: P1-068759 VL DNA

SEQ ID NO: 367 - DNA, 369 bp, Artificial Sequence
  Synthetic: P1-068763 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 368 - DNA, 324 bp, Artificial Sequence; identical to SEQ ID NO: 328
  Synthetic: P1-068763 VL DNA

SEQ ID NO: 369 - DNA, 363 bp, Artificial Sequence
  Synthetic: P1-061015 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 370 - DNA, 324 bp, Artificial Sequence
  Synthetic: P1-061015 VL DNA
gaaattgtgttgacacagtctccagccaccctgtctttgtctccaggggaaagagccaccctctcctgcagggccagtcagagtgttagcagcagctacttagcctggtaccaacagaaacctggccaggctcccaggctcctcatctatgatgcatccaacagggccactggcatcccagccaggttcagcggcagtggatctgggacagatttcactctcaccatcagcagcctggagcctgaagattttgcaacttattactgccaacagtataatagttacccgtacacttttggccaggggaccaagctggagatcaaa

SEQ ID NO: 371 - DNA, 363 bp, Artificial Sequence
  Synthetic: P1-068748 VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 372 - DNA, 324 bp, Artificial Sequence; identical to SEQ ID NO: 370
  Synthetic: P1-068748 VL DNA

SEQ ID NO: 373 - DNA, 363 bp, Artificial Sequence
  Synthetic: P1-068744 VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 374 - DNA, 324 bp, Artificial Sequence; identical to SEQ ID NO: 370
  Synthetic: P1-068744 VL DNA

SEQ ID NO: 375 - DNA, 363 bp, Artificial Sequence
  Synthetic: P1-068736 VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattgattggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgactggggccagggaaccctggtcaccgtctcctca

SEQ ID NO: 376 - DNA, 324 bp, Artificial Sequence; identical to SEQ ID NO: 370
  Synthetic: P1-068736 VL DNA

SEQ ID NO: 377 - DNA, 363 bp, Artificial Sequence
  Synthetic: P1-068752 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagagatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgagtggggccagggaaccctggtcaccgtctcctca

SEQ ID NO: 378 - DNA, 324 bp, Artificial Sequence; identical to SEQ ID NO: 370
  Synthetic: P1-068752 VL DNA

SEQ ID NO: 379 - DNA, 363 bp, Artificial Sequence
  Synthetic: P1-068740 VH DNA
caggtgcagctggtggagtctgggggaggcgtggtccagcctgggaggtccctgagactctcctgtgcagcgtctggattcaccttcagtgactatgccatgcactgggtccgccaggctccaggcaaggggctggagtgggtggcaattatatggtatgatggaagtgataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgactggggccagggaaccctggtcaccgtctcctca

SEQ ID NO: 380 - DNA, 324 bp, Artificial Sequence; identical to SEQ ID NO: 370
  Synthetic: P1-068740 VL DNA

SEQ ID NO: 381 - DNA, 363 bp, Artificial Sequence
  Synthetic: P1-068742 VH DNA
caggtgcagctggtggagtctgggggaggcgtggtccagcctgggaggtccctgagactctcctgtgcagcgtctggattcaccttcagtgactatgccatgcactgggtccgccaggctccaggcaaggggctggagtgggtggcaattatatggtatgatggaagtgataaagactatgcagactccgtgaagggccgattcaccatctccagagacaattccaagaacacgctgtatctgcaaatgaacagcctgagagccgaggacacggctgtgtattactgtgcgagagatagtggtttttacgaagattactactttgactactggggccagggaaccctggtcaccgtctcctca

SEQ ID NO: 382 - DNA, 324 bp, Artificial Sequence; identical to SEQ ID NO: 370
  Synthetic: P1-068742 VL DNA

SEQ ID NO: 383 - DNA, 363 bp, Artificial Sequence
  Synthetic: P1-068746 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaatcaccactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 384 - DNA, 324 bp, Artificial Sequence; identical to SEQ ID NO: 370
  Synthetic: P1-068746 VL DNA

SEQ ID NO: 385 - DNA, 363 bp, Artificial Sequence
  Synthetic: P1-068750 VH DNA
caggtgcagctggtggagtctgggggaggcgtggtccagcctgggaggtccctgagactctcctgtgcagcgtctggattcaccttcagtgactatgacatgcactgggtccgccaggctccaggcaaggggctggagtgggtggcagagatatgggatgatggaagtaataaatactatgcagactccgtgaagggccgattcaccatctccagagacaattccaagaacacgctgtatctgcaaatgaacagcctgagagccgaggacacggctgtgtattactgtgcgagagatgaggaattttactcctcgtactactttgactactggggccagggaaccctggtcaccgtctcctca

SEQ ID NO: 386 - DNA, 324 bp, Artificial Sequence; identical to SEQ ID NO: 370
  Synthetic: P1-068750 VL DNA

SEQ ID NO: 387 - DNA, 363 bp, Artificial Sequence
  Synthetic: P1-068738 VH DNA
caggtgcagctggtggagtctgggggaggcgtggtccagcctgggaggtccctgagactctcctgtgcagcgtctggattcaccttcagtgagtatgcccatcactgggtccgccaggctccaggcaaggggctggagtgggtggcaattatatgggatgatggaagtaatcactactatgcagactccgtgaagggccgattcaccatctccagagacaattccaagaacacgctgtatctgcaaatgaacagcctgagagccgaggacacggctgtgtattactgtgcgagagatagtggtttttacgaagattactactttgactactggggccagggaaccctggtcaccgtctcctca

SEQ ID NO: 388 - DNA, 324 bp, Artificial Sequence; identical to SEQ ID NO: 370
  Synthetic: P1-068738 VL DNA

SEQ ID NO: 389 - DNA, 363 bp, Artificial Sequence
  Synthetic: P1-068754 VH DNA
caggtgcagctggtggagtctgggggaggcgtggtccagcctgggaggtccctgagactctcctgtgcagcgtctggattcaccttcagtgactatgacatgcactgggtccgccaggctccaggcaaggggctggagtgggtggcagagatatgggatgatggaagtaataaatactatgcagactccgtgaagggccgattcaccatctccagagacaattccaagaacacgctgtatctgcaaatgaacagcctgagagccgaggacacggctgtgtattactgtgcgagagatagtggttttcactccgattactactttgactactggggccagggaaccctggtcaccgtctcctca

SEQ ID NO: 390 - DNA, 324 bp, Artificial Sequence; identical to SEQ ID NO: 370
  Synthetic: P1-068754 VL DNA

SEQ ID NO: 391 - DNA, 369 bp, Artificial Sequence
  Synthetic: P1-070864 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 392 - DNA, 324 bp, Artificial Sequence; identical to SEQ ID NO: 328
  Synthetic: P1-070864 VL DNA

SEQ ID NO: 393 - DNA, 369 bp, Artificial Sequence
  Synthetic: P1-070866 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 394 - DNA, 324 bp, Artificial Sequence; identical to SEQ ID NO: 328
  Synthetic: P1-070866 VL DNA

SEQ ID NO: 395 - DNA, 369 bp, Artificial Sequence
  Synthetic: P1-070868 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 396 - DNA, 324 bp, Artificial Sequence; identical to SEQ ID NO: 328
  Synthetic: P1-070868 VL DNA

SEQ ID NO: 397 - DNA, 369 bp, Artificial Sequence
  Synthetic: P1-070870 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 398 - DNA, 324 bp, Artificial Sequence; identical to SEQ ID NO: 328
  Synthetic: P1-070870 VL DNA

SEQ ID NO: 399 - DNA, 369 bp, Artificial Sequence
  Synthetic: P1-070872 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 400 - DNA, 324 bp, Artificial Sequence; identical to SEQ ID NO: 328
  Synthetic: P1-070872 VL DNA

SEQ ID NO: 401 - DNA, 369 bp, Artificial Sequence
  Synthetic: P1-070874 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 402 - DNA, 324 bp, Artificial Sequence; identical to SEQ ID NO: 328
  Synthetic: P1-070874 VL DNA

SEQ ID NO: 403 - DNA, 369 bp, Artificial Sequence
  Synthetic: P1-070876 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 404 - DNA, 324 bp, Artificial Sequence; identical to SEQ ID NO: 328
  Synthetic: P1-070876 VL DNA

SEQ ID NO: 405 - DNA, 369 bp, Artificial Sequence
  Synthetic: P1-070878 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 406 - DNA, 324 bp, Artificial Sequence; identical to SEQ ID NO: 328
  Synthetic: P1-070878 VL DNA

SEQ ID NO: 407 - DNA, 369 bp, Artificial Sequence
  Synthetic: P1-070880 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 408 - DNA, 324 bp, Artificial Sequence; identical to SEQ ID NO: 328
  Synthetic: P1-070880 VL DNA

SEQ ID NO: 409 - DNA, 369 bp, Artificial Sequence
  Synthetic: P1-070882 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 410 - DNA, 324 bp, Artificial Sequence; identical to SEQ ID NO: 328
  Synthetic: P1-070882 VL DNA

SEQ ID NO: 411 - DNA, 369 bp, Artificial Sequence
  Synthetic: P1-070884 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 412 - DNA, 324 bp, Artificial Sequence; identical to SEQ ID NO: 328
  Synthetic: P1-070884 VL DNA

SEQ ID NO: 413 - DNA, 369 bp, Artificial Sequence
  Synthetic: P1-070886 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 414 - DNA, 324 bp, Artificial Sequence; identical to SEQ ID NO: 328
  Synthetic: P1-070886 VL DNA

SEQ ID NO: 415 - DNA, 369 bp, Artificial Sequence
  Synthetic: P1-070888 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 416 - DNA, 324 bp, Artificial Sequence; identical to SEQ ID NO: 328
  Synthetic: P1-070888 VL DNA

SEQ ID NO: 417 - DNA, 369 bp, Artificial Sequence
  Synthetic: P1-070890 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 418 - DNA, 324 bp, Artificial Sequence; identical to SEQ ID NO: 328
  Synthetic: P1-070890 VL DNA

SEQ ID NO: 419 - DNA, 369 bp, Artificial Sequence
  Synthetic: P1-070892 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 420 - DNA, 324 bp, Artificial Sequence; identical to SEQ ID NO: 328
  Synthetic: P1-070892 VL DNA

SEQ ID NO: 421 - DNA, 369 bp, Artificial Sequence
  Synthetic: P1-070894 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 422 - DNA, 324 bp, Artificial Sequence; identical to SEQ ID NO: 328
  Synthetic: P1-070894 VL DNA

SEQ ID NO: 423 - DNA, 369 bp, Artificial Sequence
  Synthetic: P1-070896 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 424 - DNA, 324 bp, Artificial Sequence; identical to SEQ ID NO: 328
  Synthetic: P1-070896 VL DNA

SEQ ID NO: 425 - DNA, 369 bp, Artificial Sequence
  Synthetic: P1-070898 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 426 - DNA, 324 bp, Artificial Sequence; identical to SEQ ID NO: 328
  Synthetic: P1-070898 VL DNA

SEQ ID NO: 427 - DNA, 369 bp, Artificial Sequence
  Synthetic: P1-070900 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 428 - DNA, 324 bp, Artificial Sequence; identical to SEQ ID NO: 328
  Synthetic: P1-070900 VL DNA

SEQ ID NO: 429 - DNA, 369 bp, Artificial Sequence
  Synthetic: P1-070902 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 430 - DNA, 324 bp, Artificial Sequence; identical to SEQ ID NO: 328
  Synthetic: P1-070902 VL DNA

SEQ ID NO: 431 - DNA, 369 bp, Artificial Sequence
  Synthetic: P1-070904 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 432 - DNA, 324 bp, Artificial Sequence; identical to SEQ ID NO: 328
  Synthetic: P1-070904 VL DNA

SEQ ID NO: 433 - DNA, 369 bp, Artificial Sequence
  Synthetic: P1-070906 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 434 - DNA, 324 bp, Artificial Sequence; identical to SEQ ID NO: 328
  Synthetic: P1-070906 VL DNA

SEQ ID NO: 435 - DNA, 369 bp, Artificial Sequence
  Synthetic: P1-070908 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 436 - DNA, 324 bp, Artificial Sequence; identical to SEQ ID NO: 328
  Synthetic: P1-070908 VL DNA

SEQ ID NO: 437 - DNA, 369 bp, Artificial Sequence
  Synthetic: P1-070910 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 438 - DNA, 324 bp, Artificial Sequence; identical to SEQ ID NO: 328
  Synthetic: P1-070910 VL DNA

SEQ ID NO: 439 - DNA, 369 bp, Artificial Sequence
  Synthetic: P1-070912 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 440 - DNA, 324 bp, Artificial Sequence; identical to SEQ ID NO: 328
  Synthetic: P1-070912 VL DNA

SEQ ID NO: 441 - DNA, 369 bp, Artificial Sequence
  Synthetic: P1-070914 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 442 - DNA, 324 bp, Artificial Sequence; identical to SEQ ID NO: 328
  Synthetic: P1-070914 VL DNA

SEQ ID NO: 443 - DNA, 369 bp, Artificial Sequence
  Synthetic: P1-070916 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 444 - DNA, 324 bp, Artificial Sequence; identical to SEQ ID NO: 328
  Synthetic: P1-070916 VL DNA

SEQ ID NO: 445 - DNA, 369 bp, Artificial Sequence
  Synthetic: P1-070918 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 446 - DNA, 324 bp, Artificial Sequence; identical to SEQ ID NO: 328
  Synthetic: P1-070918 VL DNA

SEQ ID NO: 447 - DNA, 369 bp, Artificial Sequence
  Synthetic: P1-070920 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 448 - DNA, 324 bp, Artificial Sequence; identical to SEQ ID NO: 328
  Synthetic: P1-070920 VL DNA

SEQ ID NO: 449 - DNA, 369 bp, Artificial Sequence
  Synthetic: P1-070922 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 450 - DNA, 324 bp, Artificial Sequence; identical to SEQ ID NO: 328
  Synthetic: P1-070922 VL DNA

SEQ ID NO: 451 - DNA, 369 bp, Artificial Sequence
  Synthetic: P1-070924 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 452 - DNA, 324 bp, Artificial Sequence; identical to SEQ ID NO: 328
  Synthetic: P1-070924 VL DNA

SEQ ID NO: 453 - DNA, 369 bp, Artificial Sequence
  Synthetic: P1-070926 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 454 - DNA, 324 bp, Artificial Sequence; identical to SEQ ID NO: 328
  Synthetic: P1-070926 VL DNA

SEQ ID NO: 455 - DNA, 369 bp, Artificial Sequence
  Synthetic: P1-070928 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 456 - DNA, 324 bp, Artificial Sequence; identical to SEQ ID NO: 328
  Synthetic: P1-070928 VL DNA

SEQ ID NO: 457 - DNA, 369 bp, Artificial Sequence
  Synthetic: P1-070930 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 458 - DNA, 324 bp, Artificial Sequence; identical to SEQ ID NO: 328
  Synthetic: P1-070930 VL DNA

SEQ ID NO: 459 - DNA, 369 bp, Artificial Sequence
  Synthetic: P1-070932 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 460 - DNA, 324 bp, Artificial Sequence; identical to SEQ ID NO: 328
  Synthetic: P1-070932 VL DNA

SEQ ID NO: 461 - DNA, 1875 bp, Artificial Sequence
  Synthetic: IgG1.3 heavy chain constant region DNA
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 462 - DNA, 324 bp, Artificial Sequence
  Synthetic: Exemplary light chain constant region DNA
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 463 - protein, 123 aa, Artificial Sequence
  Synthetic: P1-068761 VH K16R T84A
EVQLVESGGGLVQPGRSLRLSCAASGFTLEDEAMHWVRQAPGKGLEWVSGINWNSEEIGYADSVKGRFTISRDNAKNSLYLQMNSLRAEDTALYYCAKVPGYSHGWIDAEDVWGQGTMVTVSS

SEQ ID NO: 464 - protein, 123 aa, Artificial Sequence
  Synthetic: P1-068761 VH K16R
EVQLVESGGGLVQPGRSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 465 - protein, 123 aa, Artificial Sequence
  Synthetic: P1-068761 VH T84A
EVQLVESGGGLVQPGKSLRLSCAASGFTLEDEAMHWVRQAPGKGLEWVSGINWNSEEIGYADSVKGRFTISRDNAKNSLYLQMNSLRAEDTALYYCAKVPGYSHGWIDAEDVWGQGTMVTVSS

SEQ ID NO: 466 - DNA, 369 bp, Artificial Sequence
  Synthetic: P1-068761 K16R T84A DNA
gaggtgcagctggtggagtctgggggaggcttggtacagcctggcaggtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagagctgaggacacggccttgtattactgtgcaaaagttcctgggtatagccatggctggattgacgctgaagatgtctggggccaagggacaatggtcaccgtctcttca

SEQ ID NO: 467 - protein, 123 aa, Artificial Sequence
  Synthetic: P1-061029 VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 468 - protein, 123 aa, Artificial Sequence
  Synthetic: P1-061029 VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 469 - protein, 123 aa, Artificial Sequence
  Synthetic: P1-061029 VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 470 - DNA, 369 bp, Artificial Sequence
  Synthetic: P1-061029 VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgtctggggccaagggacaatggtcaccgtctcttca

SEQ ID NO: 471 - protein, 123 aa, Artificial Sequence
  Synthetic: P1-068767 VH K16R T84A
EVQLVESGGGLVQPGRSLRLSCAASGFTLEDYAMHWVRQAPGKGLEWVSGIDWNSENIGYADSVKGRFTISRDNAKNSLYLQMNSLRAEDTALYYCAKVPGYSGGWIDAEDDWGQGTMVTVSS

SEQ ID NO: 472 - protein, 123 aa, Artificial Sequence
  Synthetic: P1-068767 VH K16R
EVQLVESGGGLVQPGRSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 473 - protein, 123 aa, Artificial Sequence
  Synthetic: P1-068767 VH T84A
EVQLVESGGGLVQPGKSLRLSCAASGFTLEDYAMHWVRQAPGKGLEWVSGIDWNSENIGYADSVKGRFTISRDNAKNSLYLQMNSLRAEDTALYYCAKVPGYSGGWIDAEDDWGQGTMVTVSS

SEQ ID NO: 474 - DNA, 369 bp, Artificial Sequence
  Synthetic: P1-068767 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 475 - protein, 123 aa, Artificial Sequence
  Synthetic: P1-070868 (P1-068761_E55A) VH K16R T84A
EVQLVESGGGLVQPGRSLRLSCAASGFTLEDEAMHWVRQAPGKGLEWVSGINWNSAEIGYADSVKGRFTISRDNAKNSLYLQMNSLRAEDTALYYCAKVPGYSHGWIDAEDVWGQGTMVTVSS

SEQ ID NO: 476 - protein, 123 aa, Artificial Sequence
  Synthetic: P1-070868 VH K16R
EVQLVESGGGLVQPGRSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 477 - protein, 123 aa, Artificial Sequence
  Synthetic: P1-070868 VH T84A
EVQLVESGGGLVQPGKSLRLSCAASGFTLEDEAMHWVRQAPGKGLEWVSGINWNSAEIGYADSVKGRFTISRDNAKNSLYLQMNSLRAEDTALYYCAKVPGYSHGWIDAEDVWGQGTMVTVSS

SEQ ID NO: 478 - DNA, 369 bp, Artificial Sequence; identical to SEQ ID NO: 474
  Synthetic: P1-070868 VH K16R T84A DNA

SEQ ID NO: 479 - protein, 123 aa, Artificial Sequence
  Synthetic: P1-70906 (P1-068767_D52N) VH K16R T84A
EVQLVESGGGLVQPGRSLRLSCAASGFTLEDYAMHWVRQAPGKGLEWVSGINWNSENIGYADSVKGRFTISRDNAKNSLYLQMNSLRAEDTALYYCAKVPGYSGGWIDAEDDWGQGTMVTVSS

SEQ ID NO: 480 - protein, 123 aa, Artificial Sequence
  Synthetic: P1-70906 VH K16R
EVQLVESGGGLVQPGRSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 481 - protein, 123 aa, Artificial Sequence
  Synthetic: P1-70906 VH T84A
EVQLVESGGGLVQPGKSLRLSCAASGFTLEDYAMHWVRQAPGKGLEWVSGINWNSENIGYADSVKGRFTISRDNAKNSLYLQMNSLRAEDTALYYCAKVPGYSGGWIDAEDDWGQGTMVTVSS

SEQ ID NO: 482 - DNA, 369 bp, Artificial Sequence
  Synthetic: P1-70906 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 483 - protein, 123 aa, Artificial Sequence
  Synthetic: P1-70908 (P1-068767_E55A) VH K16R T84A
EVQLVESGGGLVQPGRSLRLSCAASGFTLEDYAMHWVRQAPGKGLEWVSGIDWNSANIGYADSVKGRFTISRDNAKNSLYLQMNSLRAEDTALYYCAKVPGYSGGWIDAEDDWGQGTMVTVSS

SEQ ID NO: 484 - protein, 123 aa, Artificial Sequence
  Synthetic: P1-70908 VH K16R
EVQLVESGGGLVQPGRSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 485 - protein, 123 aa, Artificial Sequence
  Synthetic: P1-70908 VH T84A
EVQLVESGGGLVQPGKSLRLSCAASGFTLEDYAMHWVRQAPGKGLEWVSGIDWNSANIGYADSVKGRFTISRDNAKNSLYLQMNSLRAEDTALYYCAKVPGYSGGWIDAEDDWGQGTMVTVSS

SEQ ID NO: 486 - DNA, 369 bp, Artificial Sequence
  Synthetic: P1-70908 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 487 - protein, 123 aa, Artificial Sequence
  Synthetic: P1-70916 (P1-068767_D52N_E55A) VH K16R T84A
EVQLVESGGGLVQPGRSLRLSCAASGFTLEDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 488 - protein, 123 aa, Artificial Sequence
  Synthetic: P1-70916 VH K16R
EVQLVESGGGLVQPGRSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 489 - protein, 123 aa, Artificial Sequence
  Synthetic: P1-70916 VH T84A
EVQLVESGGGLVQPGKSLRLSCAASGFTLEDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 490 - DNA, 369 bp, Artificial Sequence
  Synthetic: P1-70916 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 491 - protein, 123 aa, Artificial Sequence
  Synthetic: P1-72000 (P1-061029_F100fE_V102D) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 492 - protein, 108 aa, Artificial Sequence; identical to SEQ ID NO: 12
  Synthetic: P1-72000 (P1-061029_F100fE_V102D) VL

SEQ ID NO: 493 - protein, 452 aa, Artificial Sequence
  Synthetic: P1-72000 (P1-061029_F100fE_V102D) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 494 - protein, 215 aa, Artificial Sequence; identical to SEQ ID NO: 14
  Synthetic: P1-72000 (P1-061029_F100fE_V102D) LC

SEQ ID NO: 495 - DNA, 369 bp, Artificial Sequence
  Synthetic: P1-72000 (P1-061029_F100fE_V102D) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgactggggccaagggacaatggtcaccgtctcttca

SEQ ID NO: 496 - DNA, 324 bp, Artificial Sequence; identical to SEQ ID NO: 328
  Synthetic: P1-72000 (P1-061029_F100fE_V102D) VL DNA

SEQ ID NO: 497 - DNA, 1359 bp, Artificial Sequence
  Synthetic: P1-72000 (P1-061029_F100fE_V102D) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgactggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 498 - DNA, 648 bp, Artificial Sequence
  Synthetic: P1-72000 (P1-061029_F100fE_V102D) LC DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 499 - protein, 123 aa, Artificial Sequence
  Synthetic: P1-72000 (P1-061029_F100fE_V102D) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 500 - protein, 123 aa, Artificial Sequence
  Synthetic: P1-72000 (P1-061029_F100fE_V102D) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 501 - protein, 123 aa, Artificial Sequence
  Synthetic: P1-72000 (P1-061029_F100fE_V102D) VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 502 - DNA, 369 bp, Artificial Sequence
  Synthetic: P1-72000 (P1-061029_F100fE_V102D) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgactggggccaagggacaatggtcaccgtctcttca

SEQ ID NO: 503 - protein, 123 aa, Artificial Sequence
  Synthetic: P1-72002 (P1-061029_F100fE) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 504 - protein, 108 aa, Artificial Sequence; identical to SEQ ID NO: 12
  Synthetic: P1-72002 (P1-061029_F100fE) VL

SEQ ID NO: 505 - protein, 452 aa, Artificial Sequence
  Synthetic: P1-72002 (P1-061029_F100fE) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 506 - protein, 215 aa, Artificial Sequence; identical to SEQ ID NO: 14
  Synthetic: P1-72002 (P1-061029_F100fE) LC

SEQ ID NO: 507 - DNA, 369 bp, Artificial Sequence
  Synthetic: P1-72002 (P1-061029_F100fE) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttca

SEQ ID NO: 508 - DNA, 324 bp, Artificial Sequence; identical to SEQ ID NO: 328
  Synthetic: P1-72002 (P1-061029_F100fE) VL DNA

SEQ ID NO: 509 - DNA, 1359 bp, Artificial Sequence
  Synthetic: P1-72002 (P1-061029_F100fE) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 510 - DNA, 648 bp, Artificial Sequence; identical to SEQ ID NO: 498
  Synthetic: P1-72002 (P1-061029_F100fE) LC DNA

SEQ ID NO: 511 - protein, 123 aa, Artificial Sequence
  Synthetic: P1-72002 (P1-061029_F100fE) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 512 - protein, 123 aa, Artificial Sequence
  Synthetic: P1-72002 (P1-061029_F100fE) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 513 - protein, 123 aa, Artificial Sequence; identical to SEQ ID NO: 501
  Synthetic: P1-72002 (P1-061029_F100fE) VH T84A

SEQ ID NO: 514 - DNA, 369 bp, Artificial Sequence
  Synthetic: P1-72002 (P1-061029_F100fE) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgtctggggccaagggacaatggtcaccgtctcttca

SEQ ID NO: 515 - protein, 123 aa, Artificial Sequence
  Synthetic: P1-72004 (P1-061029_V102D) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSS

SEQ ID NO: 516 - protein, 108 aa, Artificial Sequence; identical to SEQ ID NO: 12
  Synthetic: P1-72004 (P1-061029_ V102D) VL

SEQ ID NO: 517 - protein, 452 aa, Artificial Sequence
  Synthetic: P1-72004 (P1-061029_ V102D) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 518 - protein, 215 aa, Artificial Sequence; identical to SEQ ID NO: 14
  Synthetic: P1-72004 (P1-061029_ V102D) LC

SEQ ID NO: 519 - DNA, 369 bp, Artificial Sequence
  Synthetic: P1-72004 (P1-061029_ V102D) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 520 - DNA, 324 bp, Artificial Sequence; identical to SEQ ID NO: 328
  Synthetic: P1-72004 (P1-061029_ V102D) VL DNA

SEQ ID NO: 521 - DNA, 1359 bp, Artificial Sequence
  Synthetic: P1-72004 (P1-061029_ V102D) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 522 - DNA, 648 bp, Artificial Sequence; identical to SEQ ID NO: 498
  Synthetic: P1-72004 (P1-061029_ V102D) LC DNA

SEQ ID NO: 523 - protein, 123 aa, Artificial Sequence
  Synthetic: P1-72004 (P1-061029_ V102D) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAFDDWGQGTMVTVSS

SEQ ID NO: 524 - protein, 123 aa, Artificial Sequence
  Synthetic: P1-72004 (P1-061029_ V102D) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSS

SEQ ID NO: 525 - protein, 123 aa, Artificial Sequence
  Synthetic: P1-72004 (P1-061029_ V102D) VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAFDDWGQGTMVTVSS

SEQ ID NO: 526 - DNA, 369 bp, Artificial Sequence
  Synthetic: P1-72004 (P1-061029_ V102D) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgactggggccaagggacaatggtcaccgtctcttca

SEQ ID NO: 527 - protein, 123 aa, Artificial Sequence
  Synthetic: P1-72006 (P1-061029_Y32E) VH
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 528 - protein, 108 aa, Artificial Sequence; identical to SEQ ID NO: 12
  Synthetic: P1-72006 (P1-061029_ Y32E) VL

SEQ ID NO: 529 - protein, 452 aa, Artificial Sequence
  Synthetic: P1-72006 (P1-061029_ Y32E) HC
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 530 - protein, 215 aa, Artificial Sequence; identical to SEQ ID NO: 14
  Synthetic: P1-72006 (P1-061029_ Y32E) LC

SEQ ID NO: 531 - DNA, 369 bp, Artificial Sequence
  Synthetic: P1-72006 (P1-061029_ Y32E) VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 532 - DNA, 324 bp, Artificial Sequence; identical to SEQ ID NO: 328
  Synthetic: P1-72006 (P1-061029_ Y32E) VL DNA

SEQ ID NO: 533 - DNA, 1359 bp, Artificial Sequence
  Synthetic: P1-72006 (P1-061029_ Y32E) HC DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 534 - DNA, 648 bp, Artificial Sequence; identical to SEQ ID NO: 498
  Synthetic: P1-72006 (P1-061029_ Y32E) LC DNA

SEQ ID NO: 535 - protein, 123 aa, Artificial Sequence
  Synthetic: P1-72006 (P1-061029_ Y32E) VH K16R T84A
EVQLVESGGGLVQPGRSLRLSCAASGFTLDDEAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 536 - protein, 123 aa, Artificial Sequence
  Synthetic: P1-72006 (P1-061029_ Y32E) VH K16R
EVQLVESGGGLVQPGRSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 537 - protein, 123 aa, Artificial Sequence
  Synthetic: P1-72006 (P1-061029_ Y32E) VH T84A
EVQLVESGGGLVQPGKSLRLSCAASGFTLDDEAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 538 - DNA, 369 bp, Artificial Sequence
  Synthetic: P1-72006 (P1-061029_ Y32E) VH K16R T84A DNA
gaggtgcagctggtggagtctgggggaggcttggtacagcctggcaggtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgtctggggccaagggacaatggtcaccgtctcttca

SEQ ID NO: 539 - protein, 123 aa, Artificial Sequence
  Synthetic: P1-72008 (P1-061029_Y32E_F100fE) VH
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 540 - protein, 108 aa, Artificial Sequence; identical to SEQ ID NO: 12
  Synthetic: P1-72008 (P1-061029_ Y32E_F100fE) VL

SEQ ID NO: 541 - protein, 452 aa, Artificial Sequence
  Synthetic: P1-72008 (P1-061029_ Y32E_F100fE) HC
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 542 - protein, 215 aa, Artificial Sequence; identical to SEQ ID NO: 14
  Synthetic: P1-72008 (P1-061029_ Y32E_F100fE) LC

SEQ ID NO: 543 - DNA, 369 bp, Artificial Sequence
  Synthetic: P1-72008 (P1-061029_ Y32E_F100fE) VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttca

SEQ ID NO: 544 - DNA, 324 bp, Artificial Sequence; identical to SEQ ID NO: 328
  Synthetic: P1-72008 (P1-061029_ Y32E_F100fE) VL DNA

SEQ ID NO: 545 - DNA, 1359 bp, Artificial Sequence
  Synthetic: P1-72008 (P1-061029_ Y32E_F100fE) HC DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 546 - DNA, 648 bp, Artificial Sequence; identical to SEQ ID NO: 498
  Synthetic: P1-72008 (P1-061029_ Y32E_F100fE) LC DNA

SEQ ID NO: 547 - protein, 123 aa, Artificial Sequence
  Synthetic: P1-72008 (P1-061029_ Y32E_F100fE) VH K16R T84A
EVQLVESGGGLVQPGRSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 548 - protein, 123 aa, Artificial Sequence
  Synthetic: P1-72008 (P1-061029_ Y32E_F100fE) VH K16R
EVQLVESGGGLVQPGRSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 549 - protein, 123 aa, Artificial Sequence
  Synthetic: P1-72008 (P1-061029_ Y32E_F100fE) VH T84A
EVQLVESGGGLVQPGKSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 550 - DNA, 369 bp, Artificial Sequence
  Synthetic: P1-72008 (P1-061029_ Y32E_F100fE) VH K16R T84A DNA
gaggtgcagctggtggagtctgggggaggcttggtacagcctggcaggtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgtctggggccaagggacaatggtcaccgtctcttca

SEQ ID NO: 551 - protein, 137 aa, Artificial Sequence
  Synthetic: VISTA.4 VH  41F11 With signal sequence, which is underlined
MEFGLSWVFLVAIIKGVQCQVQLVESGGGLVKPGGSLRLSCAASGFTFSDYYMSWIRQAPGKGLEWVSYISNSGSPIYYADSVKGRFTISRDNAKNSLYLQMNSLRAEDTAVYYCARDLPGWYFDLWGRGTLVTVSS

SEQ ID NO: 552 - protein, 127 aa, Artificial Sequence
  Synthetic: VISTA.4 VK1 VL 41F11 With signal sequence, which is underlined
MEAPAQLLFLLLLWLPDTTGEIVLTQSPATLSLSPGERATLSCRASQSVSSYLAWYQQKPGQAPRLLIYDASNRATGIPARFSASGSGTDFTLTISSLEPEDFAVYYCQQRNNWPRTFGQGTKVEIK

SEQ ID NO: 553 - protein, 129 aa, Artificial Sequence
  Synthetic: VISTA.4 VK2 VL 41F11 With signal sequence, which is underlined
MDMRVLAQLLGLLLLCFPGARCDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 554 - protein, 128 aa, Artificial Sequence
  Synthetic: VISTA.4 VK3 VL 41F11 With signal sequence, which is underlined
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 555 - DNA, 411 bp, Artificial Sequence
  Synthetic: VISTA.4 VH DNA 41F11 With signal sequence, which is underlined
atggagtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactattacatgagctggatccgccaggctccagggaaggggctggagtgggtttcatacattagtaatagtggtagtcccatatactacgcagactctgtgaagggccgattcaccatctccagggacaacgccaagaactcactgtatctgcaaatgaacagcctgagagccgaggacacggccgtgtattactgtgcgagagatctcccgggctggtacttcgatctctggggccgtggcaccctggtcactgtctcctca

SEQ ID NO: 556 - DNA, 381 bp, Artificial Sequence
  Synthetic: VISTA.4 VK1 VL DNA With signal sequence, which is underlined
atggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtgccagtgggtctgggacagacttcactctcaccatcagcagcctagagcctgaagattttgcagtttattactgtcagcagcgtaacaactggcctcggacgttcggccaagggaccaaggtggaaatcaaa

SEQ ID NO: 557 - protein, 127 aa, Artificial Sequence
  Synthetic: VISTA.4.A64G VK1 VL With signal sequence, which is underlined
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRNNWPRTFGQGTKVEIK

SEQ ID NO: 558 - protein, 234 aa, Artificial Sequence
  Synthetic: VISTA.4.A64G LC With signal sequence, which is underlined
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 559 - protein, 121 aa, Artificial Sequence
  Synthetic: VISTA.5 VH
AVQLQESGPGLVRPSQSLSLTCTVTDYSITSDYAWNWIRQFPGSKLEWLGFIGYSGNTNYNPSLESRISITRHTSKNQFFLHLNSMTTEDTATYYCARSLYGGSHWYFDVWGAGTTVTVSS

SEQ ID NO: 560 - protein, 111 aa, Artificial Sequence
  Synthetic: VISTA.5 VK1, VL
DIVLTQSPASLAVSLGQRATISCRGSESVEYYGTILMQWYQQKPGQPPKLLIYGASNVESGVPARFSGSGSGTDFSLNIHPVEEDDIAMYFCQQSRKVPWTFGGGTKLEIK

SEQ ID NO: 561 - DNA, 363 bp, Artificial Sequence
  Synthetic: VISTA.5 VH DNA
gctgtgcagcttcaggagtcgggacctggcctggtgagaccttctcagtctctgtccctcacctgcactgtcactgactactcaatcaccagtgattatgcctggaactggatccggcagtttccaggaagcaaactggagtggctgggcttcataggctacagtggtaacactaactacaacccatctctcgaaagtcgaatctctatcactcgacacacatccaagaaccagttcttcctgcacttgaattctatgactactgaggacacagccacatattactgtgcaagatccctctacggtggtagtcactggtacttcgatgtctggggcgcagggaccacggtcaccgtctcctca

SEQ ID NO: 562 - DNA, 333 bp, Artificial Sequence
  Synthetic: VISTA.5 VK1, VL DNA
gacattgtgctcacccaatctccagcttctttggctgtgtctctagggcagagagccaccatctcctgcagaggcagtgaaagtgttgaatattatggcacaattttaatgcagtggtaccaacagaaaccaggacagccacccaaactcctcatctatggtgcatccaacgtagaatctggggtccctgccaggtttagtggcagtgggtctgggacagacttcagcctcaacatccatcctgtggaggaggatgatattgcaatgtatttctgtcagcaaagtaggaaggttccgtggacgttcggtggaggcaccaagctggaaatcaaa

SEQ ID NO: 563 - protein, 10 aa, Artificial Sequence
  Synthetic: CDR1 of P1-061029 with substitutions
  misc_feature (4)..(4): X = D or L
  misc_feature (5)..(5): X = E or D
  misc_feature (7)..(7): X = E or Y
GFTXXDXAMH

SEQ ID NO: 564 - protein, 16 aa, Artificial Sequence
  Synthetic: CDR2 of P1-061029 with substitutions
  misc_feature (3)..(3): X = D or N
  misc_feature (5)..(5): X = D or N
  misc_feature (7)..(7): X = D, E, H, or A
  misc_feature (8)..(8): X = D, E, H, or N
GIXWXSXXIGYADSVK

SEQ ID NO: 565 - protein, 14 aa, Artificial Sequence
  Synthetic: CDR3 of P1-061029 with substitutions
  misc_feature (6)..(6): X = E, H, or G
  misc_feature (12)..(12): X = E, D, or F
  misc_feature (14)..(14): X = D, E, or V
VPGYSXGWIDAXDX

SEQ ID NO: 566 - protein, 12 aa, Artificial Sequence
  Synthetic: Region 1 hVISTA epitope
LGPVDKGHDVTF

SEQ ID NO: 567 - protein, 12 aa, Artificial Sequence
  Synthetic: Region 2 hVISTA epitope
RRPIRNLTFQDL

SEQ ID NO: 568 - protein, 18 aa, Artificial Sequence
  Synthetic: Region 3 hVISTA epitope
VVEIRHHHSEHRVHGAME

SEQ ID NO: 569 - protein, 107 aa, Artificial Sequence
  Synthetic: P1-061015 VL with T85V substitution
EIVLTQSPATLSLSPGERATLSCRASQSVSSSYLAWYQQKPGQAPRLLIYDASNRATGIPARFSGSGSGTDFTLTISSLEPEDFAVYCQQYNSYPYTFGQGTKLEIK

SEQ ID NO: 570 - protein, 121 aa, Artificial Sequence
  Synthetic: P1-077835 (P1-068744 E31S)VH
QVQLVESGGGVVQPGRSLRLSCAASGFTFSSYAMHWVRQAPGKGLEWVAHIWYDGSNKYEADSVKGRFTISRDNSKNTLYLQMNSLRAEDTAVYYCARDSGFYESYYFDEWGQGTLVTVSS

SEQ ID NO: 571 - DNA, 363 bp, Artificial Sequence
  Synthetic: P1-077835 (P1-068744 E31S)VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 572 - protein, 108 aa, Artificial Sequence; identical to SEQ ID NO: 96
  Synthetic: P1-077835 (P1-068744 E31S)VL

SEQ ID NO: 573 - DNA, 324 bp, Artificial Sequence; identical to SEQ ID NO: 370
  Synthetic: P1-077835 (P1-068744 E31S)VL DNA

SEQ ID NO: 574 - protein, 121 aa, Artificial Sequence
  Synthetic: P1-077837 (P1-068744 H50I)VH
QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYESYYFDEWGQGTLVTVSS

SEQ ID NO: 575 - DNA, 363 bp, Artificial Sequence
  Synthetic: P1-077837 (P1-068744 H50I) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 576 - protein, 108 aa, Artificial Sequence; identical to SEQ ID NO: 96
  Synthetic: P1-077837 (P1-068744 H50I)VL

SEQ ID NO: 577 - DNA, 324 bp, Artificial Sequence; identical to SEQ ID NO: 370
  Synthetic: P1-077837 (P1-068744 H50I)VL DNA

SEQ ID NO: 578 - protein, 121 aa, Artificial Sequence
  Synthetic: P1-077839 (P1-068744 E59Y)VH
QVQLVESGGGVVQPGRSLRLSCAASGFTFSEYAMHWVRQAPGKGLEWVAHIWYDGSNKYYADSVKGRFTISRDNSKNTLYLQMNSLRAEDTAVYYCARDSGFYESYYFDEWGQGTLVTVSS

SEQ ID NO: 579 - DNA, 363 bp, Artificial Sequence
  Synthetic: P1-077839 (P1-068744 E59Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 580 - protein, 108 aa, Artificial Sequence; identical to SEQ ID NO: 96
  Synthetic: P1-077839 (P1-068744 E59Y)VL

SEQ ID NO: 581 - DNA, 324 bp, Artificial Sequence; identical to SEQ ID NO: 370
  Synthetic: P1-077839 (P1-068744 E59Y)VL DNA

SEQ ID NO: 582 - protein, 121 aa, Artificial Sequence
  Synthetic: P1-077841 (P1-068744 E100S)VH
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYSSYYFDEWGQGTLVTVSS

SEQ ID NO: 583 - DNA, 363 bp, Artificial Sequence
  Synthetic: P1-077841 (P1-068744 E100S) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttactcctcgtactactttgacgagtggggccagggaaccctggtcaccgtctcctca

SEQ ID NO: 584 - protein, 108 aa, Artificial Sequence; identical to SEQ ID NO: 96
  Synthetic: P1-077841 (P1-068744 E100S)VL

SEQ ID NO: 585 - DNA, 324 bp, Artificial Sequence; identical to SEQ ID NO: 370
  Synthetic: P1-077841 (P1-068744 E100S)VL DNA

SEQ ID NO: 586 - protein, 121 aa, Artificial Sequence
  Synthetic: P1-077843 (P1-068744 E102Y)VH
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDYWGQGTLVTVSS

SEQ ID NO: 587 - DNA, 363 bp, Artificial Sequence
  Synthetic: P1-077843 (P1-068744 E102Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgactactggggccagggaaccctggtcaccgtctcctca

SEQ ID NO: 588 - protein, 108 aa, Artificial Sequence; identical to SEQ ID NO: 96
  Synthetic: P1-077843 (P1-068744 E102Y)VL

SEQ ID NO: 589 - DNA, 324 bp, Artificial Sequence; identical to SEQ ID NO: 370
  Synthetic: P1-077843 (P1-068744 E102Y)VL DNA

SEQ ID NO: 590 - protein, 121 aa, Artificial Sequence
  Synthetic: P1-077845 (P1-068744 E31S H50I)VH
QVQLVESGGGVVQPGRSLRLSCAASGFTFSSYAMHWVRQAPGKGLEWVAIIWYDGSNKYEADSVKGRFTISRDNSKNTLYLQMNSLRAEDTAVYYCARDSGFYESYYFDEWGQGTLVTVSS

SEQ ID NO: 591 - DNA, 363 bp, Artificial Sequence
  Synthetic: P1-077845 (P1-068744 E31S H50I) VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 592 - protein, 108 aa, Artificial Sequence; identical to SEQ ID NO: 96
  Synthetic: P1-077845 (P1-068744 E31S H50I)VL

SEQ ID NO: 593 - DNA, 324 bp, Artificial Sequence; identical to SEQ ID NO: 370
  Synthetic: P1-077845 (P1-068744 E31S H50I) VL DNA

SEQ ID NO: 594 - protein, 121 aa, Artificial Sequence
  Synthetic: P1-077847 (P1-068744 H50I E59Y)VH
QVQLVESGGGVVQPGRSLRLSCAASGFTFSEYAMHWVRQAPGKGLEWVAIIWYDGSNKYYADSVKGRFTISRDNSKNTLYLQMNSLRAEDTAVYYCARDSGFYESYYFDEWGQGTLVTVSS

SEQ ID NO: 595 - DNA, 363 bp, Artificial Sequence
  Synthetic: P1-077847 (P1-068744 H50I E59Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 596 - protein, 108 aa, Artificial Sequence; identical to SEQ ID NO: 96
  Synthetic: P1-077847 (P1-068744 H50I E59Y)VL

SEQ ID NO: 597 - DNA, 324 bp, Artificial Sequence; identical to SEQ ID NO: 370
  Synthetic: P1-077847 (P1-068744 H50I E59Y) VL DNA

SEQ ID NO: 598 - protein, 121 aa, Artificial Sequence
  Synthetic: P1-077849 (P1-068744 E59Y E100S)VH
QVQLVESGGGVVQPGRSLRLSCAASGFTFSEYAMHWVRQAPGKGLEWVAHIWYDGSNKYYADSVKGRFTISRDNSKNTLYLQMNSLRAEDTAVYYCARDSGFYSSYYFDEWGQGTLVTVSS

SEQ ID NO: 599 - DNA, 363 bp, Artificial Sequence
  Synthetic: P1-077849 (P1-068744 E59Y E100S) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgacgagtggggccagggaaccctggtcaccgtctcctca

SEQ ID NO: 600 - protein, 108 aa, Artificial Sequence; identical to SEQ ID NO: 96
  Synthetic: P1-077849 (P1-068744 E59Y E100S)VL

SEQ ID NO: 601 - DNA, 324 bp, Artificial Sequence; identical to SEQ ID NO: 370
  Synthetic: P1-077849 (P1-068744 E59Y E100S) VL DNA

SEQ ID NO: 602 - protein, 121 aa, Artificial Sequence
  Synthetic: P1-077851 (P1-068744 E100S E102Y)VH
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYSSYYFDYWGQGTLVTVSS

SEQ ID NO: 603 - DNA, 363 bp, Artificial Sequence
  Synthetic: P1-077851 (P1-068744 E100S E102Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 604 - protein, 108 aa, Artificial Sequence; identical to SEQ ID NO: 96
  Synthetic: P1-077851 (P1-068744 E100S E102Y)VL

SEQ ID NO: 605 - DNA, 324 bp, Artificial Sequence; identical to SEQ ID NO: 370
  Synthetic: P1-077851 (P1-068744 E100S E102Y) VL DNA

SEQ ID NO: 606 - protein, 121 aa, Artificial Sequence
  Synthetic: P1-077853 (P1-068744 E31S E102Y)VH
QVQLVESGGGVVQPGRSLRLSCAASGFTFSSYAMHWVRQAPGKGLEWVAHIWYDGSNKYEADSVKGRFTISRDNSKNTLYLQMNSLRAEDTAVYYCARDSGFYESYYFDYWGQGTLVTVSS

SEQ ID NO: 607 - DNA, 363 bp, Artificial Sequence
  Synthetic: P1-077853 (P1-068744 E31S E102Y) VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgactactggggccagggaaccctggtcaccgtctcctca

SEQ ID NO: 608 - protein, 108 aa, Artificial Sequence; identical to SEQ ID NO: 96
  Synthetic: P1-077853 (P1-068744 E31S E102Y)VL

SEQ ID NO: 609 - DNA, 324 bp, Artificial Sequence; identical to SEQ ID NO: 370
  Synthetic: P1-077853 (P1-068744 E31S E102Y) VL DNA

SEQ ID NO: 610 - protein, 121 aa, Artificial Sequence
  Synthetic: P1-077855 (P1-068744 E31S E59Y)VH
QVQLVESGGGVVQPGRSLRLSCAASGFTFSSYAMHWVRQAPGKGLEWVAHIWYDGSNKYYADSVKGRFTISRDNSKNTLYLQMNSLRAEDTAVYYCARDSGFYESYYFDEWGQGTLVTVSS

SEQ ID NO: 611 - DNA, 363 bp, Artificial Sequence
  Synthetic: P1-077855 (P1-068744 E31S E59Y) VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcacatatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 612 - protein, 108 aa, Artificial Sequence; identical to SEQ ID NO: 96
  Synthetic: P1-077855 (P1-068744 E31S E59Y)VL

SEQ ID NO: 613 - DNA, 324 bp, Artificial Sequence; identical to SEQ ID NO: 370
  Synthetic: P1-077855 (P1-068744 E31S E59Y) VL DNA

SEQ ID NO: 614 - protein, 121 aa, Artificial Sequence
  Synthetic: P1-077857 (P1-068744 E31S E100S)VH
QVQLVESGGGVVQPGRSLRLSCAASGFTFSSYAMHWVRQAPGKGLEWVAHIWYDGSNKYEADSVKGRFTISRDNSKNTLYLQMNSLRAEDTAVYYCARDSGFYSSYYFDEWGQGTLVTVSS

SEQ ID NO: 615 - DNA, 363 bp, Artificial Sequence
  Synthetic: P1-077857 (P1-068744 E31S E100S) VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttactcctcgtactactttgacgagtggggccagggaaccctggtcaccgtctcctca

SEQ ID NO: 616 - protein, 108 aa, Artificial Sequence; identical to SEQ ID NO: 96
  Synthetic: P1-077857 (P1-068744 E31S E100S)VL

SEQ ID NO: 617 - DNA, 324 bp, Artificial Sequence; identical to SEQ ID NO: 370
  Synthetic: P1-077857 (P1-068744 E31S E100S) VL DNA

SEQ ID NO: 618 - protein, 121 aa, Artificial Sequence
  Synthetic: P1-077859 (P1-068744 H50I E100S)VH
QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYSSYYFDEWGQGTLVTVSS

SEQ ID NO: 619 - DNA, 363 bp, Artificial Sequence
  Synthetic: P1-077859 (P1-068744 H50I E100S) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttactcctcgtactactttgacgagtggggccagggaaccctggtcaccgtctcctca

SEQ ID NO: 620 - protein, 108 aa, Artificial Sequence; identical to SEQ ID NO: 96
  Synthetic: P1-077859 (P1-068744 H50I E100S)VL

SEQ ID NO: 621 - DNA, 324 bp, Artificial Sequence; identical to SEQ ID NO: 370
  Synthetic: P1-077859 (P1-068744 H50I E100S) VL DNA

SEQ ID NO: 622 - protein, 121 aa, Artificial Sequence
  Synthetic: P1-077861 (P1-068744 H50I E102Y)VH
QVQLVESGGGVVQPGRSLRLSCAASGFTFSEYAMHWVRQAPGKGLEWVAIIWYDGSNKYEADSVKGRFTISRDNSKNTLYLQMNSLRAEDTAVYYCARDSGFYESYYFDYWGQGTLVTVSS

SEQ ID NO: 623 - DNA, 363 bp, Artificial Sequence
  Synthetic: P1-077861 (P1-068744 H50I E102Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgactactggggccagggaaccctggtcaccgtctcctca

SEQ ID NO: 624 - protein, 108 aa, Artificial Sequence; identical to SEQ ID NO: 96
  Synthetic: P1-077861 (P1-068744 H50I E102Y)VL

SEQ ID NO: 625 - DNA, 324 bp, Artificial Sequence; identical to SEQ ID NO: 370
  Synthetic: P1-077861 (P1-068744 H50I E102Y) VL DNA

SEQ ID NO: 626 - protein, 121 aa, Artificial Sequence
  Synthetic: P1-077863 (P1-068744 E59Y E102Y)VH
QVQLVESGGGVVQPGRSLRLSCAASGFTFSEYAMHWVRQAPGKGLEWVAHIWYDGSNKYYADSVKGRFTISRDNSKNTLYLQMNSLRAEDTAVYYCARDSGFYESYYFDYWGQGTLVTVSS

SEQ ID NO: 627 - DNA, 363 bp, Artificial Sequence
  Synthetic: P1-077863 (P1-068744 E59Y E102Y) VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttacgaatcgtactactttgactactggggccagggaaccctggtcaccgtctcctca

SEQ ID NO: 628 - protein, 108 aa, Artificial Sequence; identical to SEQ ID NO: 96
  Synthetic: P1-077863 (P1-068744 E59Y E102Y)VL

SEQ ID NO: 629 - DNA, 324 bp, Artificial Sequence; identical to SEQ ID NO: 370
  Synthetic: P1-077863 (P1-068744 E59Y E102Y) VL DNA

SEQ ID NO: 630 - protein, 121 aa, Artificial Sequence
  Synthetic: P1-077865 (P1-068748 H31S)VH
QVQLVESGGGVVQPGRSLRLSCAASGFTFSSHAMHWVRQAPGKGLEWVAIIWYDGSNDDYADSVKGRFTISRDNSKNTLYLQMNSLRAEDTAVYYCARDSGFYDSYYFDYWGQGTLVTVSS

SEQ ID NO: 631 - DNA, 363 bp, Artificial Sequence
  Synthetic: P1-077865 (P1-068748 H31S) VH DNA
caggtgcagctggtggagtctgggggaggcgtggtccagcctgggaggtccctgagactctcctgtgcagcgtctggattcaccttcagtagccatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 632 - protein, 108 aa, Artificial Sequence; identical to SEQ ID NO: 96
  Synthetic: P1-077865 (P1-068748 H31S)VL

SEQ ID NO: 633 - DNA, 324 bp, Artificial Sequence; identical to SEQ ID NO: 370
  Synthetic: P1-077865 (P1-068748 H31S) VL DNA

SEQ ID NO: 634 - protein, 121 aa, Artificial Sequence
  Synthetic: P1-077867 (P1-068748 H32Y)VH
QVQLVESGGGVVQPGRSLRLSCAASGFTFSHYAMHWVRQAPGKGLEWVAIIWYDGSNDDYADSVKGRFTISRDNSKNTLYLQMNSLRAEDTAVYYCARDSGFYDSYYFDYWGQGTLVTVSS

SEQ ID NO: 635 - DNA, 363 bp, Artificial Sequence
  Synthetic: P1-077867 (P1-068748 H32Y) VH DNA
caggtgcagctggtggagtctgggggaggcgtggtccagcctgggaggtccctgagactctcctgtgcagcgtctggattcaccttcagtcactatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 636 - protein, 108 aa, Artificial Sequence; identical to SEQ ID NO: 96
  Synthetic: P1-077867 (P1-068748 H32Y)VL

SEQ ID NO: 637 - DNA, 324 bp, Artificial Sequence; identical to SEQ ID NO: 370
  Synthetic: P1-077867 (P1-068748 H32Y) VL DNA

SEQ ID NO: 638 - protein, 121 aa, Artificial Sequence
  Synthetic: P1-077869 (P1-068748 D57K)VH
QVQLVESGGGVVQPGRSLRLSCAASGFTFSHHAMHWVRQAPGKGLEWVAIIWYDGSNKDYADSVKGRFTISRDNSKNTLYLQMNSLRAEDTAVYYCARDSGFYDSYYFDYWGQGTLVTVSS

SEQ ID NO: 639 - DNA, 363 bp, Artificial Sequence
  Synthetic: P1-077869 (P1-068748 D57K) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 640 - protein, 108 aa, Artificial Sequence; identical to SEQ ID NO: 96
  Synthetic: P1-077869 (P1-068748 D57K)VL

SEQ ID NO: 641 - DNA, 324 bp, Artificial Sequence; identical to SEQ ID NO: 370
  Synthetic: P1-077869 (P1-068748 D57K) VL DNA

SEQ ID NO: 642 - protein, 121 aa, Artificial Sequence
  Synthetic: P1-077871 (P1-068748 D58Y)VH
QVQLVESGGGVVQPGRSLRLSCAASGFTFSHHAMHWVRQAPGKGLEWVAIIWYDGSNDYYADSVKGRFTISRDNSKNTLYLQMNSLRAEDTAVYYCARDSGFYDSYYFDYWGQGTLVTVSS

SEQ ID NO: 643 - DNA, 363 bp, Artificial Sequence
  Synthetic: P1-077871 (P1-068748 D58Y) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaatgactactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 644 - protein, 108 aa, Artificial Sequence; identical to SEQ ID NO: 96
  Synthetic: P1-077871 (P1-068748 D58Y)VL

SEQ ID NO: 645 - DNA, 324 bp, Artificial Sequence; identical to SEQ ID NO: 370
  Synthetic: P1-077871 (P1-068748 D58Y) VL DNA

SEQ ID NO: 646 - protein, 121 aa, Artificial Sequence
  Synthetic: P1-077873 (P1-068748 D100S)VH
QVQLVESGGGVVQPGRSLRLSCAASGFTFSHHAMHWVRQAPGKGLEWVAIIWYDGSNDDYADSVKGRFTISRDNSKNTLYLQMNSLRAEDTAVYYCARDSGFYSSYYFDYWGQGTLVTVSS

SEQ ID NO: 647 - DNA, 363 bp, Artificial Sequence
  Synthetic: P1-077873 (P1-068748 D100S) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 648 - protein, 108 aa, Artificial Sequence; identical to SEQ ID NO: 96
  Synthetic: P1-077873 (P1-068748 D100S)VL

SEQ ID NO: 649 - DNA, 324 bp, Artificial Sequence; identical to SEQ ID NO: 370
  Synthetic: P1-077873 (P1-068748 D100S) VL DNA

SEQ ID NO: 650 - protein, 121 aa, Artificial Sequence
  Synthetic: P1-077875 (P1-068748 H31S H32Y)VH
QVQLVESGGGVVQPGRSLRLSCAASGFTFSSYAMHWVRQAPGKGLEWVAIIWYDGSNDDYADSVKGRFTISRDNSKNTLYLQMNSLRAEDTAVYYCARDSGFYDSYYFDYWGQGTLVTVSS

SEQ ID NO: 651 - DNA, 363 bp, Artificial Sequence
  Synthetic: P1-077875 (P1-068748 H31S H32Y) VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 652 - protein, 108 aa, Artificial Sequence; identical to SEQ ID NO: 96
  Synthetic: P1-077875 (P1-068748 H31S H32Y)VL

SEQ ID NO: 653 - DNA, 324 bp, Artificial Sequence; identical to SEQ ID NO: 370
  Synthetic: P1-077875 (P1-068748 H32Y D57K) VL DNA

SEQ ID NO: 654 - protein, 121 aa, Artificial Sequence
  Synthetic: P1-077877 (P1-068748 H32Y D57K)VH
QVQLVESGGGVVQPGRSLRLSCAASGFTFSHYAMHWVRQAPGKGLEWVAIIWYDGSNKDYADSVKGRFTISRDNSKNTLYLQMNSLRAEDTAVYYCARDSGFYDSYYFDYWGQGTLVTVSS

SEQ ID NO: 655 - DNA, 363 bp, Artificial Sequence
  Synthetic: P1-077877 (P1-068748 H32Y D57K) VH DNA
caggtgcagctggtggagtctgggggaggcgtggtccagcctgggaggtccctgagactctcctgtgcagcgtctggattcaccttcagtcactatgccatgcactgggtccgccaggctccaggcaaggggctggagtgggtggcaattatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 656 - protein, 363 aa, Artificial Sequence
  Synthetic: P1-077877 (P1-068748 H32Y D57K)VL
CAGGTGCAGCTGGTGGAGTCTGGGGGAGGCGTGGTCCAGCCTGGGAGGTCCCTGAGACTCTCCTGTGCAGCGTCTGGATTCACCTTCAGTCACTATGCCATGCACTGGGTCCGCCAGGCTCCAGGCAAGGGGCTGGAGTGGGTGGCAATTATATGGTATGATGGAAGTAATAAAGACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGTGGTTTTTACGACTCGTACTACTTTGACTACTGGGGCCAGGGAACCCTGGTCACCGTCTCCTCA

SEQ ID NO: 657 - DNA, 324 bp, Artificial Sequence; identical to SEQ ID NO: 370
  Synthetic: P1-077877 (P1-068748 H32Y D57K) VL DNA

SEQ ID NO: 658 - protein, 121 aa, Artificial Sequence
  Synthetic: P1-077879 (P1-068748 D57K D58Y)VH
QVQLVESGGGVVQPGRSLRLSCAASGFTFSHHAMHWVRQAPGKGLEWVAIIWYDGSNKYYADSVKGRFTISRDNSKNTLYLQMNSLRAEDTAVYYCARDSGFYDSYYFDYWGQGTLVTVSS

SEQ ID NO: 659 - DNA, 363 bp, Artificial Sequence
  Synthetic: P1-077879 (P1-068748 D57K D58Y) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 660 - protein, 108 aa, Artificial Sequence; identical to SEQ ID NO: 96
  Synthetic: P1-077879 (P1-068748 D57K D58Y)VL

SEQ ID NO: 661 - DNA, 324 bp, Artificial Sequence; identical to SEQ ID NO: 370
  Synthetic: P1-077879 (P1-068748 D57K D58Y) VL DNA

SEQ ID NO: 662 - protein, 121 aa, Artificial Sequence
  Synthetic: P1-077881 (P1-068748 D58Y D100S)VH
QVQLVESGGGVVQPGRSLRLSCAASGFTFSHHAMHWVRQAPGKGLEWVAIIWYDGSNDYYADSVKGRFTISRDNSKNTLYLQMNSLRAEDTAVYYCARDSGFYSSYYFDYWGQGTLVTVSS

SEQ ID NO: 663 - DNA, 363 bp, Artificial Sequence
  Synthetic: P1-077881 (P1-068748 D58Y D100S) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaatgactactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 664 - protein, 108 aa, Artificial Sequence; identical to SEQ ID NO: 96
  Synthetic: P1-077881 (P1-068748 D58Y D100S)VL

SEQ ID NO: 665 - DNA, 324 bp, Artificial Sequence; identical to SEQ ID NO: 370
  Synthetic: P1-077881 (P1-068748 D58Y D100S) VL DNA

SEQ ID NO: 666 - protein, 121 aa, Artificial Sequence
  Synthetic: P1-077883 (P1-068748 H31S D57K)VH
QVQLVESGGGVVQPGRSLRLSCAASGFTFSSHAMHWVRQAPGKGLEWVAIIWYDGSNKDYADSVKGRFTISRDNSKNTLYLQMNSLRAEDTAVYYCARDSGFYDSYYFDYWGQGTLVTVSS

SEQ ID NO: 667 - DNA, 363 bp, Artificial Sequence
  Synthetic: P1-077883 (P1-068748 H31S D57K) VH DNA
caggtgcagctggtggagtctgggggaggcgtggtccagcctgggaggtccctgagactctcctgtgcagcgtctggattcaccttcagtagccatgccatgcactgggtccgccaggctccaggcaaggggctggagtgggtggcaattatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 668 - protein, 108 aa, Artificial Sequence; identical to SEQ ID NO: 96
  Synthetic: P1-077883 (P1-068748 H31S D57K)VL

SEQ ID NO: 669 - DNA, 324 bp, Artificial Sequence; identical to SEQ ID NO: 370
  Synthetic: P1-077883 (P1-068748 H31S D57K) VL DNA

SEQ ID NO: 670 - protein, 121 aa, Artificial Sequence
  Synthetic: P1-077885 (P1-068748 H31S D58Y)VH
QVQLVESGGGVVQPGRSLRLSCAASGFTFSSHAMHWVRQAPGKGLEWVAIIWYDGSNDYYADSVKGRFTISRDNSKNTLYLQMNSLRAEDTAVYYCARDSGFYDSYYFDYWGQGTLVTVSS

SEQ ID NO: 671 - DNA, 363 bp, Artificial Sequence
  Synthetic: P1-077885 (P1-068748 H31S D58Y) VH DNA
caggtgcagctggtggagtctgggggaggcgtggtccagcctgggaggtccctgagactctcctgtgcagcgtctggattcaccttcagtagccatgccatgcactgggtccgccaggctccaggcaaggggctggagtgggtggcaattatatggtatgatggaagtaatgactactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 672 - protein, 108 aa, Artificial Sequence; identical to SEQ ID NO: 96
  Synthetic: P1-077885 (P1-068748 H31S D58Y)VL

SEQ ID NO: 673 - DNA, 324 bp, Artificial Sequence; identical to SEQ ID NO: 370
  Synthetic: P1-077885 (P1-068748 H31S D58Y) VL DNA

SEQ ID NO: 674 - protein, 121 aa, Artificial Sequence
  Synthetic: P1-077887 (P1-068748 H31S D100S)VH
QVQLVESGGGVVQPGRSLRLSCAASGFTFSSHAMHWVRQAPGKGLEWVAIIWYDGSNDDYADSVKGRFTISRDNSKNTLYLQMNSLRAEDTAVYYCARDSGFYSSYYFDYWGQGTLVTVSS

SEQ ID NO: 675 - DNA, 363 bp, Artificial Sequence
  Synthetic: P1-077887 (P1-068748 H31S D100S) VH DNA
caggtgcagctggtggagtctgggggaggcgtggtccagcctgggaggtccctgagactctcctgtgcagcgtctggattcaccttcagtagccatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 676 - protein, 108 aa, Artificial Sequence; identical to SEQ ID NO: 96
  Synthetic: P1-077887 (P1-068748 H31S D100S)VL

SEQ ID NO: 677 - DNA, 324 bp, Artificial Sequence; identical to SEQ ID NO: 370
  Synthetic: P1-077887 (P1-068748 H31S D100S) VL DNA

SEQ ID NO: 678 - protein, 121 aa, Artificial Sequence
  Synthetic: P1-077889 (P1-068748 H32Y D58Y)VH
QVQLVESGGGVVQPGRSLRLSCAASGFTFSHYAMHWVRQAPGKGLEWVAIIWYDGSNDYYADSVKGRFTISRDNSKNTLYLQMNSLRAEDTAVYYCARDSGFYDSYYFDYWGQGTLVTVSS

SEQ ID NO: 679 - DNA, 363 bp, Artificial Sequence
  Synthetic: P1-077889 (P1-068748 H32Y D58Y) VH DNA
caggtgcagctggtggagtctgggggaggcgtggtccagcctgggaggtccctgagactctcctgtgcagcgtctggattcaccttcagtcactatgccatgcactgggtccgccaggctccaggcaaggggctggagtgggtggcaattatatggtatgatggaagtaatgactactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 680 - protein, 108 aa, Artificial Sequence; identical to SEQ ID NO: 96
  Synthetic: P1-077889 (P1-068748 H32Y D58Y)VL

SEQ ID NO: 681 - DNA, 324 bp, Artificial Sequence; identical to SEQ ID NO: 370
  Synthetic: P1-077889 (P1-068748 H32Y D58Y) VL DNA

SEQ ID NO: 682 - protein, 121 aa, Artificial Sequence
  Synthetic: P1-077891 (P1-068748 H32Y D100S)VH
QVQLVESGGGVVQPGRSLRLSCAASGFTFSHYAMHWVRQAPGKGLEWVAIIWYDGSNDDYADSVKGRFTISRDNSKNTLYLQMNSLRAEDTAVYYCARDSGFYSSYYFDYWGQGTLVTVSS

SEQ ID NO: 683 - DNA, 363 bp, Artificial Sequence
  Synthetic: P1-077891 (P1-068748 H32Y D100S) VH DNA
caggtgcagctggtggagtctgggggaggcgtggtccagcctgggaggtccctgagactctcctgtgcagcgtctggattcaccttcagtcactatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 684 - protein, 108 aa, Artificial Sequence; identical to SEQ ID NO: 96
  Synthetic: P1-077891 (P1-068748 H32Y D100S)VL

SEQ ID NO: 685 - DNA, 324 bp, Artificial Sequence; identical to SEQ ID NO: 370
  Synthetic: P1-077891 (P1-068748 H32Y D100S) VL DNA

SEQ ID NO: 686 - protein, 121 aa, Artificial Sequence
  Synthetic: P1-077893 (P1-068748 D57K D100S)VH
QVQLVESGGGVVQPGRSLRLSCAASGFTFSHHAMHWVRQAPGKGLEWVAIIWYDGSNKDYADSVKGRFTISRDNSKNTLYLQMNSLRAEDTAVYYCARDSGFYSSYYFDYWGQGTLVTVSS

SEQ ID NO: 687 - DNA, 363 bp, Artificial Sequence
  Synthetic: P1-077893 (P1-068748 D57K D100S) VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 688 - protein, 108 aa, Artificial Sequence; identical to SEQ ID NO: 96
  Synthetic: P1-077893 (P1-068748 D57K D100S)VL

SEQ ID NO: 689 - DNA, 324 bp, Artificial Sequence; identical to SEQ ID NO: 370
  Synthetic: P1-077893 (P1-068748 D57K D100S) VL DNA

SEQ ID NO: 690 - protein, 10 aa, Artificial Sequence
  Synthetic: CDR1 based on P1-061015 and P1-068744
  misc_feature (6)..(6): X is E or S
GFTFSXYAMH

SEQ ID NO: 691 - protein, 17 aa, Artificial Sequence
  Synthetic: CDR2 based on P1-061015 and P1-068744
  misc_feature (1)..(1): X is H or I
  misc_feature (11)..(11): X is E or Y
XIWYDGSNKYXADSVKG

SEQ ID NO: 692 - protein, 12 aa, Artificial Sequence
  Synthetic: CDR3 based on P1-061015 and P1-068744
  misc_feature (6)..(6): X is E or S
  misc_feature (12)..(12): X is E or Y
DSGFYXSYYFDX

SEQ ID NO: 693 - protein, 10 aa, Artificial Sequence
  Synthetic: CDR1 based on P1-061015 and P1-068748
  misc_feature (6)..(6): X is H or S
  misc_feature (7)..(7): X is H or Y
GFTFSXXAMH

SEQ ID NO: 694 - protein, 17 aa, Artificial Sequence
  Synthetic: CDR2 based on P1-061015 and P1-068748
  misc_feature (9)..(9): X is D or K
  misc_feature (10)..(10): X is D or Y
IIWYDGSNXXYADSVKG

SEQ ID NO: 695 - protein, 12 aa, Artificial Sequence
  Synthetic: CDR3 based on P1-061015 and P1-068748
  misc_feature (6)..(6): X is D
DSGFYXSYYFDY

SEQ ID NO: 696 - protein, 14 aa, Artificial Sequence
  Synthetic: P1-061029 HCDR3 sequence with mutation
EPGYSGGWIDAFDV

SEQ ID NO: 697 - protein, 14 aa, Artificial Sequence
  Synthetic: P1-061029 HCDR3 sequence with mutation
EDGYSGGWIDAFDV

SEQ ID NO: 698 - protein, 14 aa, Artificial Sequence
  Synthetic: P1-061029 HCDR3 sequence with mutation
EPDYSGGWIDAFDV

SEQ ID NO: 699 - protein, 14 aa, Artificial Sequence
  Synthetic: P1-061029 HCDR3 sequence with mutation
EPGDSGGWIDAFDV

SEQ ID NO: 700 - protein, 14 aa, Artificial Sequence
  Synthetic: P1-061029 HCDR3 sequence with mutation
EPGYDGGWIDAFDV

SEQ ID NO: 701 - protein, 14 aa, Artificial Sequence
  Synthetic: P1-061029 HCDR3 sequence with mutation
EPGYSDGWIDAFDV

SEQ ID NO: 702 - protein, 14 aa, Artificial Sequence
  Synthetic: P1-061029 HCDR3 sequence with mutation
EPGYSGDWIDAFDV

SEQ ID NO: 703 - protein, 14 aa, Artificial Sequence
  Synthetic: P1-061029 HCDR3 sequence with mutation
EPGYSGGDIDAFDV

SEQ ID NO: 704 - protein, 14 aa, Artificial Sequence
  Synthetic: P1-061029 HCDR3 sequence with mutation
EPGYSGGWDDAFDV

SEQ ID NO: 705 - protein, 14 aa, Artificial Sequence
  Synthetic: P1-061029 HCDR3 sequence with mutation
EPGYSGGWIDAFDV

SEQ ID NO: 706 - protein, 14 aa, Artificial Sequence
  Synthetic: P1-061029 HCDR3 sequence with mutation
EPGYSGGWIDDFDV

SEQ ID NO: 707 - protein, 14 aa, Artificial Sequence
  Synthetic: P1-061029 HCDR3 sequence with mutation
EPGYSGGWIDADDV

SEQ ID NO: 708 - protein, 14 aa, Artificial Sequence
  Synthetic: P1-061029 HCDR3 sequence with mutation
EPGYSGGWIDAFDV

SEQ ID NO: 709 - protein, 14 aa, Artificial Sequence
  Synthetic: P1-061029 HCDR3 sequence with mutation
EPGYSGGWIDAFDD

SEQ ID NO: 710 - protein, 14 aa, Artificial Sequence
  Synthetic: P1-061029 HCDR3 sequence with mutation
HPGYSGGWIDAFDV

SEQ ID NO: 711 - protein, 14 aa, Artificial Sequence
  Synthetic: P1-061029 HCDR3 sequence with mutation
HDGYSGGWIDAFDV

SEQ ID NO: 712 - protein, 14 aa, Artificial Sequence
  Synthetic: P1-061029 HCDR3 sequence with mutation
HPDYSGGWIDAFDV

SEQ ID NO: 713 - protein, 14 aa, Artificial Sequence
  Synthetic: P1-061029 HCDR3 sequence with mutation
HPGDSGGWIDAFDV

SEQ ID NO: 714 - protein, 14 aa, Artificial Sequence
  Synthetic: P1-061029 HCDR3 sequence with mutation
HPGYDGGWIDAFDV

SEQ ID NO: 715 - protein, 14 aa, Artificial Sequence
  Synthetic: P1-061029 HCDR3 sequence with mutation
HPGYSDGWIDAFDV

SEQ ID NO: 716 - protein, 14 aa, Artificial Sequence
  Synthetic: P1-061029 HCDR3 sequence with mutation
HPGYSGDWIDAFDV

SEQ ID NO: 717 - protein, 14 aa, Artificial Sequence
  Synthetic: P1-061029 HCDR3 sequence with mutation
HPGYSGGDIDAFDV

SEQ ID NO: 718 - protein, 14 aa, Artificial Sequence
  Synthetic: P1-061029 HCDR3 sequence with mutation
HPGYSGGWDDAFDV

SEQ ID NO: 719 - protein, 14 aa, Artificial Sequence
  Synthetic: P1-061029 HCDR3 sequence with mutation
HPGYSGGWIDAFDV

SEQ ID NO: 720 - protein, 14 aa, Artificial Sequence
  Synthetic: P1-061029 HCDR3 sequence with mutation
HPGYSGGWIDDFDV

SEQ ID NO: 721 - protein, 14 aa, Artificial Sequence
  Synthetic: P1-061029 HCDR3 sequence with mutation
HPGYSGGWIDADDV

SEQ ID NO: 722 - protein, 14 aa, Artificial Sequence
  Synthetic: P1-061029 HCDR3 sequence with mutation
HPGYSGGWIDAFDV

SEQ ID NO: 723 - protein, 14 aa, Artificial Sequence
  Synthetic: P1-061029 HCDR3 sequence with mutation
HPGYSGGWIDAFDD

SEQ ID NO: 724 - protein, 14 aa, Artificial Sequence
  Synthetic: P1-061029 HCDR3 sequence with mutation
DPGYSGGWIDAFDV

SEQ ID NO: 725 - protein, 14 aa, Artificial Sequence
  Synthetic: P1-061029 HCDR3 sequence with mutation
DDGYSGGWIDAFDV

SEQ ID NO: 726 - protein, 14 aa, Artificial Sequence
  Synthetic: P1-061029 HCDR3 sequence with mutation
DPDYSGGWIDAFDV

SEQ ID NO: 727 - protein, 14 aa, Artificial Sequence
  Synthetic: P1-061029 HCDR3 sequence with mutation
DPGDSGGWIDAFDV

SEQ ID NO: 728 - protein, 14 aa, Artificial Sequence
  Synthetic: P1-061029 HCDR3 sequence with mutation
DPGYDGGWIDAFDV

SEQ ID NO: 729 - protein, 14 aa, Artificial Sequence
  Synthetic: P1-061029 HCDR3 sequence with mutation
DPGYSDGWIDAFDV

SEQ ID NO: 730 - protein, 14 aa, Artificial Sequence
  Synthetic: P1-061029 HCDR3 sequence with mutation
DPGYSGDWIDAFDV

SEQ ID NO: 731 - protein, 14 aa, Artificial Sequence
  Synthetic: P1-061029 HCDR3 sequence with mutation
DPGYSGGDIDAFDV

SEQ ID NO: 732 - protein, 14 aa, Artificial Sequence
  Synthetic: P1-061029 HCDR3 sequence with mutation
DPGYSGGWDDAFDV

SEQ ID NO: 733 - protein, 14 aa, Artificial Sequence
  Synthetic: P1-061029 HCDR3 sequence with mutation
DPGYSGGWIDAFDV

SEQ ID NO: 734 - protein, 14 aa, Artificial Sequence
  Synthetic: P1-061029 HCDR3 sequence with mutation
DPGYSGGWIDDFDV

SEQ ID NO: 735 - protein, 14 aa, Artificial Sequence
  Synthetic: P1-061029 HCDR3 sequence with mutation
DPGYSGGWIDADDV

SEQ ID NO: 736 - protein, 14 aa, Artificial Sequence
  Synthetic: P1-061029 HCDR3 sequence with mutation
DPGYSGGWIDAFDV

SEQ ID NO: 737 - protein, 14 aa, Artificial Sequence
  Synthetic: P1-061029 HCDR3 sequence with mutation
DPGYSGGWIDAFDD

SEQ ID NO: 738 - protein, 200 aa, Artificial Sequence
  Synthetic: epitope of VISTA.4
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGA

The invention claimed is:

1. An antibody that specifically binds to human VISTA (hVISTA), wherein the antibody comprises a heavy chain variable region (VH) comprising VH complementarity determining region 1 (CDR1), CDR2 and CDR3 comprising the amino acid sequence of residues 26-35, 50-56, and 99-110, respectively, of SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686, and a light chain variable region (VL) comprising the amino acid sequence of residues 24-35, 51-57, and 90-98, respectively, of SEQ ID NO: 96.

2. The antibody of claim 1, wherein the antibody comprises a VH comprising an amino acid sequence that is at least 95% identical to that of SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686.

3. The antibody of claim 1, wherein the antibody comprises a VH comprising the amino acid sequence of SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686.

4. The antibody of claim 1, wherein the antibody comprises a VL comprising an amino acid sequence that is at least 95% identical to that of SEQ ID NO: 96.

5. The antibody of claim 1, wherein the antibody comprises a VL comprising the amino acid sequence of SEQ ID NO: 96 or of SEQ ID NO: 96 modified by a T85V substitution.

6. The antibody of claim 1, wherein the antibody comprises a heavy chain constant region comprising the amino acid sequence of SEQ ID NO: 182, 183, or 184.

7. The antibody of claim 1, wherein the antibody comprises a light chain (LC) comprising the amino acid sequence of SEQ ID NO: 98, or of SEQ ID NO: 98 modified by a T85V substitution.

8. The antibody of claim 1, wherein the antibody binds near the histidine rich region of h VISTA.

9. The antibody of claim 1, wherein the antibody binds near the histidine rich region of h VISTA in conditions having a pH of 6.0-6.5.

10. The antibody of claim 1, wherein the antibody competes or cross-competes for binding to hVISTA with an antibody comprising a VH comprising the amino acid sequence of SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686; and a VL comprising the amino acid sequence of SEQ ID NO: 96.

11. The antibody of claim 1, wherein the antibody does not bind significantly to a h VISTA modified in that one or more of the following amino acid residues have been mutated: T35, Y37, K38, T39, Y41, R54, T61, F62, Q63, L65, H66, L67, H68, H69, F97, L115, V117, I119, H121, H122, S124, E125, R127, as determined by yeast mutational analysis.

12. The antibody of claim 1, wherein the antibody specifically binds to hVISTA under acidic conditions, and wherein the antibody:

inhibits the interaction between hVISTA and (a) T cells, (b) PSGL-1, or (c) VSIG-3;

enhances T cell activation by enhancing T cell proliferation; enhancing IFN-γ production from T cells; or stimulating T cell receptor mediated NF-kB signaling;

contacts h VISTA through one or more residues Y37, T39, R54, F62, H66, V117, I119 or S124, as determined using a yeast surface display and NGS assay;

and wherein numbering is that of mature hVISTA (SEQ ID NO: 2);

binds to the histidine-rich β-sheet extension of h VISTA;

contacts H121, H122 and/or H123 of mature h VISTA;

binds to Region 1: $_{57}$LGPVDKGHDVTF$_{68}$ (SEQ ID NO: 566); Region 2: $_{86}$RRPIRNLTFQDL$_{97}$ (SEQ ID NO: 567); and Region 3: $_{148}$VVEIRHHHSEHRHGAME$_{165}$ (SEQ ID NO: 568) of h VISTA having SEQ ID NO: 1;

competes for binding to h VISTA with an antibody comprising VH and VL amino acid sequences as follows:

a VH comprising the amino acid sequence of SEQ ID NO: 95 and a VL comprising the amino acid sequence of SEQ ID NO: 96;

a VH comprising the amino acid sequence of SEQ ID NO: 103 and a VL comprising the amino acid sequence of SEQ ID NO: 104;

a VH comprising the amino acid sequence of SEQ ID NO: 99 and a VL comprising the amino acid sequence of SEQ ID NO: 100;

a VH comprising the amino acid sequence of SEQ ID NO: 67 and a VL comprising the amino acid sequence of SEQ ID NO: 68;

a VH comprising the amino acid sequence of SEQ ID NO: 53 and a VL comprising the amino acid sequence of SEQ ID NO: 54;

a VH comprising the amino acid sequence of SEQ ID NO: 55 and a VL comprising the amino acid sequence of SEQ ID NO: 56; or a VH comprising the amino acid sequence of SEQ ID NO: 551 and a VL comprising the amino acid sequence of SEQ ID NO: 552;

contacts hVISTA through at least one glutamic acid, aspartic acid or histidine residue that is located in VH CDR1, CDR2 or CDR3;

has a mean residence time (MRT) of at least 100, 200, 300, 400, 500, 600 or 700 hours;

accumulates preferably in tumor tissues in comparison to lung, liver, and spleen in hVISTA knock-in mice harboring MC38 tumors; or accumulates preferably in tumor tissues in comparison to lung, liver, and spleen in a subject to which the antibody was administered.

13. The antibody of claim 1, wherein the antibody specifically binds to hVISTA under acidic conditions with a $K_D$ (or koff) that is at least 10 fold, 100 fold or 1000 fold lower than its $K_D$ or koff of binding to hVISTA under neutral or physiological pH, and wherein the antibody:

specifically binds to hVISTA at a histidine rich region of the hVISTA extracellular domain (ECD) or a polypeptide comprising amino acid residues 35-127 of SEQ ID NO: 2;

lacks significant binding to hVISTA at a histidine rich region of the ECD or a polypeptide comprising amino acid residues 35-127 of SEQ ID NO: 2, at physiological pH or neutral pH;

specifically binds to cynomolgus (cyno) VISTA at a histidine rich region of the ECD, at acidic pH;

lacks significant binding to cyno VISTA at a histidine rich region of the ECD, at physiological pH or neutral pH;

has reduced binding to hVISTA-ECD having a substitution at one or more of the following amino acids: T35, Y37, K38, T39, Y41, R54, T61, F62, Q63, L65, H66, L67, H68, H69, F97, L115, V117, I119, H121, H122, S124, E125, R127 relative to hVISTA ECD having SEQ ID NO: 2;

cross-competes for binding to hVISTA with an antibody comprising VH and VL amino acid sequences as follows: a VH comprising the amino acid sequence of SEQ ID NO: 95 and a VL comprising the amino acid sequence of SEQ ID NO: 96; a VH comprising the amino acid sequence of SEQ ID NO: 103 and a VL comprising the amino acid sequence of SEQ ID NO: 104; or a VH comprising the amino acid sequence of SEQ ID NO: 99 and a VL comprising the amino acid sequence of SEQ ID NO: 100;

inhibits binding of hVISTA to human T cells expressing VISTA at acidic pH;

inhibits binding of hVISTA to PSGL-1 at acidic pH, wherein PSGL-1 is with or without siayl lewis X;

has a mean residence time (MRT) of at least 100, 200, 300, 350, 400, 450, 500, 600 or 700 hours in cynomolgus monkeys;

stimulates T cell activation by enhancing T cell proliferation; enhancing IFN-γ production from T cells; or stimulating T cell receptor mediated NF-kB signaling;

inhibits VISTA mediated cell: cell adhesion;

specifically binds to hVISTA in samples of human tumor cells or samples of inflamed human tissue that express VISTA;

contacts hVISTA through one or more residues Y37, T39, R54, F62, H66, V117, I119 or S124, as determined using a yeast surface display and NGS assay, and wherein numbering is that of mature hVISTA (SEQ ID NO: 2);

binds to Region 1 of hVISTA: ${}_{57}$LGPVDKGHDVTF${}_{68}$ (SEQ ID NO: 566); Region 2: ${}_{86}$RRPIRNLTFQDL${}_{97}$ (SEQ ID NO: 567); and Region 3: ${}_{148}$VVEIRHHHSEHRVHGAME${}_{165}$ (SEQ ID NO: 568) having SEQ ID NO: 1, and optionally wherein the binding is strongest to Region 2, as determined by MS-HDX;

binds to the histidine-rich β-sheet extension of hVISTA, as determined by crystallography;

contacts H121, H122 and/or H123 of mature hVISTA (distance of 4.0 Ångströms (Å) or less), as determined by crystallography; or contacts hVISTA through at least one glutamic acid, aspartic acid or histidine residue that is located in VH CDR1, CDR2 or CDR3.

14. The antibody of claim 1, wherein the antibody has an isoelectric point (pI) between 6.5 and 6.8, as measured by icIEF.

15. The antibody of claim 1, which is an IgG1, IgG2 or IgG4 antibody.

16. An isolated nucleic acid encoding an antibody of claim 1.

17. A cell comprising the isolated nucleic acid of claim 16.

18. A method of preparing an antibody, comprising culturing the cell of claim 17 in conditions under which the antibody is expressed.

19. A composition comprising an isolated antibody of claim 1 and a pharmaceutically acceptable carrier.

20. A method of treating cancer in a subject, comprising administering to the subject a therapeutically effective amount of the antibody of claim 1, wherein the antibody stimulates an immune response and/or is a VISTA antagonist.

21. A method of treating an infectious disease in a subject, comprising administering to the subject a therapeutically effective amount of the antibody of claim 1, wherein the antibody stimulates an immune response and/or is a VISTA antagonist.

22. The antibody of claim 1, wherein the antibody comprises a VH comprising the amino acid sequence SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686, modified by 1, 2, 3, 4, or 5 amino acid substitutions in the framework regions.

23. The antibody of claim 1, wherein the antibody comprises a VH comprising the amino acid sequence of SEQ ID NO: 570, 574, 578, 582, 586, 590, 594, 598, 602, 606, 610, 614, 618, 622, 626, 630, 634, 638, 642, 646, 650, 654, 658, 662, 666, 670, 674, 678, 682, or 686, and a VL comprising the amino acid sequence of SEQ ID NO: 96.

* * * * *